United States Patent 10,724,096 (METHODS AND COMPOSITIONS FOR INHIBITING AND TREATING NEUROLOGICAL CONDITIONS) - sequence listing, part 51

SEQ ID NO: 1101 - DNA, 392827 bp, Homo sapiens
tgctgctttgattgcaataaaggttcatgcacaaagtaagagaaataacaggaacaaaaataaagaaaagaaaaaagttcaggctaggtcaacaagtccacgtttcctacctgaactgtgggctctgggatgggttgttggggacagaccttgaagcagagaggaccacagagccaggaccagggccacagggcttgaggaattgtctattcctgctgagggtggggagttcaggagagcaacgatttctgttccttgttgatgaccttggccaactcttcgactcctcaggctgctctttttcccgcccccaggtggcgctctttcctccttccttcccacccctccattggtgacttcatccaccatcgtggtgcagccctagcttctatctggacaacgcccacctttccctcccataccgatctcagtgacgtctccatgaagcccttctaagtttcacccatgcagaggtggaaatacatgattgcacttgttatttaaggaggtttcctgtgtgcccccgctgtgctgaggcctcgatatagaatctcagttattcctcaggaaatcttcgcatgcaagtggtttatttgggaaaggatcccaggaaacactggcaggagagatgggaagtgagacgggaagggaaggcggccagcaaagggggcatggatggatgagctggtcatagaatgtttgaagagacatggcttaggaaggaaattcatttgaatttttttaactttggacctgtgctttcaaatgtcttctcccttgcctggcacagtggctcatgcctgtaacccagcattttggaaggccgtgcaggaggattaattaaggccaggagtttgagactagcctgggcaacatagtgagacctcgtctctataaaaaaatcaaaaatattagtggggcatgatggtgtagacctgtagtcccagctagttgggaggctgaggagggagaattgcttgagcacaggagtttgaggctgcagtgagctatgattgtgccactgtactgcagcctgggtgacagcgcaagaccctttctaaaaaaagaaagagagagagagaagggagagagaaaagaaggaagaaaggaaggaaggaaggagaagaaagaagaaagaaaaaaagaaagaagaaagaaaaagaaagaaagatggatgaaagaaagaaaaagaaagaaagaaagagaaaaaagctcactgttagaaaaagaagattgacaaggatgaaataatgataaatcccagggggatgagcctcccagctcagtctctgctggaaaaaagtattgaaaagcacaggtccaccatgaaaagaaattaaaatgaatttcattcttaagccaaacatattccagagaatccattttaagccctcctgaacatttattgaaacccccttccatctccaaccccaaaagctccaaaggacctcacttcttgctccccttcccaagcccctgctctcagcctcctctcccctcttccccatctgtcccataaatttgatcccagcaagcaagaatcccttctttttatgagctagaaaactgaccagtgacagaagatttttattcacaggaggagagagaggatacttcattaatttcagtcctacctgttgtacatatgtgtgtcctgtaataaatcatttgtctgacccttgtttctggttcctaggaggaagcttctaattcttggaatttcctgagtgatgggattgcctgagtttatgctaacaaggtgactcgggatggtggccagccacaccagaaagaccaactgtgtgattagagagttgggactttgggccagtgacatcagcctgatgatgtctggggagtggaggggttgctggagattgagttcaatcatgtggccagttatctagtcaatcatgcctacataatgaaaccacaaaaaaacctctgaatgatgagactcagttgagctccccgggttgggagtcatacttctgtgtgctcagagggcgacacagaagctttgtgaattgggccctcccatgggttttttttgggggggttgttcctttataataaacaattatagaaagtacagtgcttttttagtgctttgagttggtctatgagttactgaacctgagagagtaatgggagcccccgaatgtgtagccagtttgtcagaagtgtgggtggcctgggagccctggcgcttgcagtgggtgcctgaagggaggacagtcttgtggaagactgtgcccttaacctgtgaaatgtgacccaagtccaggtggctggtgtcaaaactgcattgccttatactgtggctcagaccatatgacagagatgagaatctgtcatttctgcttggagaaatcagtttttggggtgtgactaatttttgctctgggacccagatttcaccccccctagagttgagagttctgcccttgtgttttattttctgcttttggctagagatgtgaatgagggtgagaagattattgcctggggattgaaaaccaggccacaatgaagtgggacccccaaggccaagagtcctgtctgtgttttcctcctatagggagattggcaggtggggtcagaggctacattcataaagcatctcaattttcctccacagtttgtgctacttaatggccctgcataaatacttctacaagagccaacaaattaatgactcataaggccctttaaagcattggaaagaaactaaaaaggagatctaatttgtttggttcaggattattggtatcaagctgggtttggtgtcttttgtttactcattggtttccaaaaataaattttgggaaaacagaccattaaggataaaagatgctccagtgtacttgaaactgtttgagaaacaggtaaaaaggcagtaaaatataaaatttattgtggctgagggtttttctaatgccaagcacaacagcagtagacagaagcacaaactgtggacaattgaccttggctggatcatgccttcttcccaatttcccagggcagagtgtcccattacgtagaaataaaaaagaaatgcattgtgtctagagcctggaatgtggggtcctctgggaatattcatttcagttacgcaacaaatatttattaagcctagattgcgcctggcctatcttgagctacttttattagaagccttctctcagaggctttaaatatctctaccacccacatatagcagctccaacgctttgatgtcatacaaaattaggccagagtcatacttccatcacccacaagctctgtgaccatgggcaacctcagcttcctcatttgtaaaaatgagttgtagtgggtgaaacagtatcctccaaaaattcatgtctactggaaactcagaatgtgagtgtatttggaaatagggtctttgcagataaaattagttaaggatctcaaggtgaaatcattctggatttagggttggctgtaaatctaacgatgagtttctatataagaaggggagaagatagagagagacagagagagagagaccgtgtgaagatggaggcagagaaagcagtgatgcatctacaagtccgtgaacaccaaggactggcaatgaccatcaggagctagaagagagtcatggaacagattctcctccagaaccagaaggaagcaaccctcccaacacctagatctgagacttctggcctccagaactctgcaagaatacatttctgttgttttgagccacacaggttgtggtcttcttttttttttttacagcagccctaggaaactaatgcactactccaaatagaattatggcctcgtaaatgaaaagatggatgcaagcatttgactgatacagatattcaaccagtgctaattcttctttcctttctaggctgattgaataggtaatgttgaagctatgggttagttttcagcttcatctatcatcttcctggtttattcattgaaaaaggttttcacgtagtaggcttaacctttttgccccagtttgggtatccgctttggagcttttccgtttatttttgtgtgtgtagcagacatcattgttgccctgcccaaatgccctcagcactcctcatttttatgcacatggactcatgcagaggtgtaactgcagcggctgcaactcttcctgagagctctctctggctgctggcacctgcttggctcacacacgagacagaaagttgaataccccctcctcccgcaggaacacccttaaaccagcgactgatgggagtcagtgcatacatttcccagctcccttgctcgcagctgggatgagtctgagccacgtttcacactgttttccagagtccccagcaggactgagcttcactttcccacagcagtgagctgcttggtaacacacacattactagttttcttcctgtgttagcttcctgtggctgccataatgtatgaccacaaacttggtggcttgaaacagtagatattattccctcctcgttctggaggccagaagtccaaaaatcagtatcagtgagctgaaataagtgtctacagagccatgctccctcaatagtctctaggggagaagccattcctggccttttccagtttctggtggctgttggctaatccttggagtttcttggtttgtggctgcatcactccagtctgtgcctccttcttcacattgccttctcttctgttacgcaacaaatatttattaagcctagatcgtgcctggcctaccttgagctactttttctagctcaagtgatcttcctctctcagcctctcaaagtgctggggttacaggtgtgagccagccgcacccggcgccctggtaagtccttcatcaaggtggagaagggtgaagattcctgtagtcaaatctctatttcccttttataaggatacatgtgatcgtattaaggactcattcagataatccaggataatctccctaccccaaggacttcaatttaactacatcagcaaagtccccttttttttccacctaaggtgtattaggtcattcttgtattgctataaagaaatacctcacactgagaaatttataagaaaagaggtttaattggctcacggttctgcagactgtacaggaagtacagcaacatctgcttttggggaggcctcaggaagcttccaatcatggtagaaggtgaagctggagcaggcatctcacatggtgaaagcaaaagagagttgggggaggtgccatccacttttaaatgacaagatctcatgagaacccactcactatgggtattagtctgttctcatgctgctaataaagacatacccaagactaggtaatttataaagaaaaagaagtttaatggacttacacttctacatggctgaggaggcctcacgatcatggcagcgggtgaaggggaagaaaaacgcatcttatactgcggcaggcaagagagtgtgtgcaagggaactcccctttataaaaccatcaggtcaaaaaaactgtgtgctgtaaaataattgtgcagtatccatacaatggaatattactcagccatgaaaaggagagatgcactgacacacactacaatgtggatcatgagacttactcactattacaagaacagcatgggaaagatccactcccatcattcaattacctccaccaggtccctcccatgacacatggcaattatgagagctaaaatggaagatgagatttgggtggggacacagccaaaccatatcactacagcaaagacagcaccaaggggatggtgcaaaaccattcatgagacatccacccctgtgatccagtcacctcccaccaggcctcacctccaatacgggggattacatttcagcctgagatttgggcagggacaaatatccaaactatatcatatggtaacattcataggtttcaggaattaagatgtgaacatccgacctaccacaattccctttctctccttacttcccattcacctatcaatgcttcctggggatcaatttaccaataaactccttactctcaactctttgccctcagcatgtgcatctggagggacctcacctctgactgtatcacttcatagggaatgagaaccaacctttcaaggaatcatttattaatttgttgcactcacattccactagcagttgtacttacatgagtctgaacaaggttgtcaaattctatgaaggtcgttgattagctcacaaccataatgccaagttggagggggtgattggcttgaacaggcttttgagtgataataacccaagaaaaagaaatgagggagaagcctactggggactctcactgctgcttgaaacatctctcagcctcactctgtgatttatgatttgatagatctagtgagagagaagttggggtgggagagtcactggccagagagtcccaaccctcatagctgtggacggtcacttgcagtgggttgggagggtaggtggtgaaatcttaggaacaggtgacacaggtgagctctttctggtaagtacctttttttttttgtttgcgttttttctttaagagacagggtcttcctgttttccaggctggagtacagtggtgcaatcatagctccctgcagcctctacctcctgggctcaagcaatcctcctgcctcagcctcctgagcagcagggactacgggtgcacaccaccatgcctggctaattttttatttttgtagagatggggtctcactacattaccctggctggtcttaaacttctgggctcaagcgatcttcccacctcagcccccaaagtgctgggattataggtgtgagccactgtgcccagccccctggtaagtccttcatcagggtagagaagaatgagagcacctctagtttcctggagctctgtaacctctgcaccaacgtaaaggtcaagactccctggttaaggctttcaactttcactggaggggctgaaaggccatgcactgtgcttggagatatttacttgtttattcacttgattgttcattcattgattcattcattcattccttttcccttctgtagaacaagtacctattgaatgtctgccatgtgcctggcagtgggggctcctgtagatcagaggagagagaaccagggaaggctgtcctgaggaagtgacattcaagtagagactccaaggagtgagttagccagaccaggagcatagggagccagagagcatctcccagcagaagacctccatgaaatgccctgaggcagaagaggaaagacctgggagggctgggaggggcggggaaaacaaagagtccagttgtcttgagcaccacgatgactggaggtcagagctggagatccaggcaagggccagctctggagctctgttggggggtttgcatcattcaaaactcagtgggaagtcacaggaggtctgggagagagagacaagagctgatggatgctttaagaacatcactcgactgggcacggtggctcatgcctgtaatcccagcactttgggaggccagggtgggcagatcacgaggtcaagagattgagaccatcctggccaacgtggtgaaaccccgtctctactaaaaatacaaaaattagcagggtgtggtggctcatgcctgtaatcccaactactcgggaagctgaggcaggagaatcgcttgaacccgggagacagaggttgcagtcagccgagatcacaccactgtagtccagcctggtgacagagtgagaatccatctcaaaaaaaaaaaaaaaaaaatcactcaccctggtcactacctcctgagtgctccaggaagggtgagggcaggaaccgatgaggctgctgtgggcatctgggtgtgatttggcgggagctggatggatggtactttggcttcattatctgtgataggttgaaagctgttccctgcaaattcctctgctgaagccctaactctcagtaccacacaatgtgactgcatttggagacagggtctttaaagaggggattaaggtaaaatgaggtcatcggagtgggctttaatccaatctgcctggtgtcctcatgagaagaggagattaatacccatttatgcctagtgttccattactggaacgctaagcatgtgagaattatttatatcctactgctcaaggtcatcgcaggggtctgattgcaaaaattcaaaaaattgcaacctcaggcataaatgttaagacacagacacacacagagggatgcacataggaggatgtggggagaaagtggctgtctgcaagccaaggaaggaggcctcaggagaaaccaaccccaccaatcgataccttgatcttggatttccagcctccagaactgtgagaaaataaaagtctgttgttgaaaccgccctgttcatggtgcttgttagggcagcctgagctgactcatgcaccctgtgtgagctaaaattgggccagcccaggtgatccagcctctctccttctcctcctgcttcgtccaaatgccccagcacctctctgttgttcacagcagcttcttagccataaaggccatatctcccatggacttgtctgctggagcatcctcccaccagcagacaagtcctggtctctggaaagcctgttggctctctgtcctctgccacctgcctcccagaattatgtgctgactctttccagatgaactcactgaaaaattgtgaactacccctctgctgccccaagtcgcctacacacttatggcaattccccaaccaaacgaatgtcacttttacattatgcagacagaccaaattagcatttagcagagaaaggggcttcttcttcttcttcttttttttttttttgcaaatcatataactctaaattaccttcaatttcccaaatggaatttggctcgagattcactctggtatggagtagtctgtaatgagattatattatgtttgggggaaaacattcaaatgaccaagataattaattttgcataacaaccaacatagagcaagctccagagctggaactcaaagcctgcaacctgcaggggcccctgggggtgatcagagttctttcaaaatacagcaacaaaggccattctggggacccgtgcaatgcccgggtttgaaagctggaaatgtcgggttctttctcctctggctactgtcttcatattttctcagcagctgtgatttgctgtaggagctgtcctgggtttggaaagacaaaaggagcccgatggctcaatagagcattctggaagagctttactgggaggaattttttgagaaaagtccctaagatttcaaaacgtttggtgctgtttcagggcccagcttagggtagggtggtgtgtgtgtatgtgtctgtgtctgtgtgtgtgtgtgtgtgtgtgtgtgtgtgtgtgtgtatgtatcttgaaaaggaaagaataagatcaaaccctcctcttgtctttgaatcttcattgtcaggtggctttatttgcatgatatcagacttgtctgaatatctgggaagaacctgacacagcggcaattttctggttctgattcattgtgaaaatcaccttggaaatagccaggacctggcatctccccacctccaccccttgcacctcttggctgtgtctcattctaacacagtttagaatatgcatcagcctgggagccagagaacctacattttcacttaggctctgcctctagctgcctgcatggtctcaaaaataaattcctgcacccaaacaaatccttgtccgtgaatgttcacagcagcactatttgcaataaccaaaaggtgggagcaaccccaatgtccaccaatgaatgagtggataaataattgtgcggtagccatacaatggaatattactcagccatcaaaaggaaagatgcactgacacacactacaatgtggatgaaactcgtggacatcttgcagagtgaaagaagccagacacaaaagatcacatattgtataattccatttacatgaaatactcagaataggtaaatccatagagatagaaaacagattagtgtgtgcccggggctgcagagcaggagtgcagaatgacagcttaatgaacgtggggcttcattttgtgctgatgaaatgctttggaactagatagtggtgtcggttgcacaacattgtgaatgtactacatgccactgagttgtaaactttaaagtgaattgtgcaattaaaatgcttacttttatattatctgaatttcacctcaataaaaaaaaaagttcctcccatccttgatctcacactggatcttggggtcttcatctgggaaaattaaggtgttggactagaaacggggattgcaaactcttactctatagaccacatttggccagcagatatttaattgggccttaacagtgttttttaacacattctaaatctgaattcctttttttgacggtcagtttccaaagatgagcctcccagcccaatgagctatccctcctggtatccatgcaatggggtggccacctccaacactgaatccaggctggccttttgaccaacagaatgcagcaggagtgacactacataattccaaagctggaccttaaggtatctgcagcttctgcctttatctcatgggatgctccctctctgaacccagaaaccatgctgtgagcaagccctcgctgcatggggaaccacatggagaagcccccacagagcagtccatgccaactgccagccatgtcagtgagcaatcttggacgttacagcccagctgagcctctgaatgatacagccctagctgatatgtattcatagagagagcagaagaaccacccagctaagcccaggcaacacacagaatcataagaaataatacaatgattattgtttaagccacgaagtttgggggtggtttctcacacagcaacagatgacaggaacagctttgactgcttctttggcttgtcacagtcctcatcttatctcctacacctgcccacttcatacatctgagctacctgcctggcccctgcaggcagctggctctgcagccccagatgtgatgatgatctctaggttcccatccaggtttgccaagtgcatattctccatgttccaatctgagcacattgagcattcatggccaagatctttcagtgggtggataagactgaattctccaaagacataggaccaacatgacatacatatgtatgtgtgtgtgtgtgtatatatatatctatacgtatatgtaggtatatgcacgtgtgtgatgtattatgtgagagagacagagtgaaagagagtgagatttattttaggaaatggcttatgcaattgtggagcccagtaagtccaaagtctgcagggaagaccagcaagcttgaggcccagggaagaggtaatgttgcatcaatagcctggacagtttgaagagagtctgcaggcagaattcccttttccttggggaatgtcagtcttttgtttctctctctccttttttttttttttagtcagaatctcgctctgtcacccaggctggaattcagtggcatgatctcggctcactgcaacctccacctctcaggttctagcgattcttgtgcctcagcctccccagtagctgggaccacaggcatgtgccaccaagcccggctaatttttagtagagatggggtttcaccatgttggccaggctggactcaaactcctggcctcaagtgatctgcctgcctcggcctcccaatatgctgggattacaggcatgagccaccacgttcgacctcttttttctgttaaaaccttcaggtggtaggatgagcctccacccacattatggagtggggtggtaatctgcttgactcaaagtctactgacttaaatattcatctcatctaaaaattctctttacagccacagctaggctgctgtttaccatatatctgggtaccatggcctggcccagctgacacataaaattaaccacgctggggggtaatgaaccaactcactgactcccatttggcttgcagattcccaaattaaacttctccccggggtcctgtggatcccttctgcatttccgggtgtacctgaccccactttagcatgctttggcccccagtgggcctgcacctcacctctccctcgggctcctggagatgatggcctggaaggcacaggtggctggagtacttgagggctgatgttccccagagggacacttggccaatgagtgaagaggttgggggcgggagggcaacttggagccctaattctccctccagtgctccctctccatgggcccaggctgaagccacagtccacagagccttcccggacctcacagccttgccgggctccaccccttccctgccagctccccgctctccctcactccctccccagtttctcctggggtgccccaatcctcatgtcagatccgtgtctgcagaacacaacacaggacagaccatcacgtgaagagaggaaaaacattcattaaggaaaaaaatcattgagcattgtcttctgtgccaagcatgatctctagacatgggagacagggcagtgaaccaagctgacaaaattccctgaactcctgaagctgacatccttccattcggatgggactccaaagtttttccaagcgaggagtagagtatatacgtctatgctgagagcgctggccttactctgttattgtcagtccggccttatccctacaaggacttggtgagaaggcaaccctctgcttcaacttgatttgtgcgttttgtgtctccccgtcaccatttcagtttcttgctcttacaaataaaggaataaagtgcacattacacgcagccaccagtgccatgcaggtctcactctttatgcagcataaccaagccctgaaggctgtctgtgctccccgtgctgctagtgagggtggattcgaggctgccagcacgtccagaccaccggcatgtccagaccccccttatctcctcatgccttcttcctgcagcctcaccccaatcctactgaagcaagatcaaagcacaaataactcccaatgtgggccttactgttccttcccatgatcagaggtcatgcgtgacccagagcgacacgcagtgtgatcactgacatcatagacacatgtagagatgcgttggtgtttggtgacgaatatggaaattcaataaaaggcaagttaattaaaacagaacaagctgtggcctggggcagggaaatgtaactgctgattgtgtgacggagagttcagctacaaggggagtgggacgttttctctctttcttcctgtgtttctttggagtctgtttggaaaaggcagattctgagtttgaggggtagggagtgaaggttccaggctgggatgcacgtgcgtggtgcacatgtgtgtggctgctccctgtgtgggttccagatgaagaagcactcacagcccatcagctccttgacaaccaggaggacaaacctggtttgtccttgcttagaatcccagtgcagacgcggtgcctggcactgactaagagtatttcttactcatgccaatagtgatgttttgaaacaaaacaccctggtatgggttgaattgcgtctcgccccttcccagttcgtatgttgacatcttaacccccaggacctcagaatatgactacattttgatatagggtcttttctgaggtaattaaggtgaagtgagatcattaggttgggttctaacccaataggactggtgcccttataaaaagagaagatcaggccgggcatggtggctcacacctgtaatccccacactttgggaggccgaagtgggcagatcacttgaggtcaggagtttgagaccagcctgggcaatatggtgaaaactcatctctactaaaaataaaaaaattggcgagcctgtaatcccagccacttgggaggctgaggcaggagaagcactcaaatccaggaggcagaggttgcagtgagccgagattgcaccactgcactccagcctgggtgacagtgtgactgtcaaacaaacaaacaaaaaaacaagaagaagaagaagagaagggaagatcaggccggtcacagtggcttatgcctgtaattccagcactttgggaggctgaggagaaaggattgcttgaggccaggagttcgagaccagcctaggtaacgtggtgagacttctctaataaaaataaaataaatcagccaggcatgctaccatgtgcctgtagtcccagctactcaggaggccgaggctggaggatagcttgagctcgagaggtggaggctgcagtgagccatgatcatgccactacactccagtctgggcaatagtacatgactcaaaaaattaaaaaaaaaaaaaaaaaaaggagatcaggacacagacacacacagggggacagccatgtgaggacacagggagaagatggcctctacaagccaaggagagagggctcaggagaaagcagccctgcagacaccttgatcttgcacttccagcctccagaattgtgagaaaatgaatttctatcgtttaagctgcccggtctgtggtatgttgttttggtggctctagcaaatgaatatataccccaaccatttatcattgctcaggggtctatgggtgggaggggtggctctgctgaaccgggctgagctcacctatgccagagcttgggtggccgttggcaggtccttgatgggctatgatccacatggcctcccatgctccagcagagagcccgggcttgttgtcatggcaacggcacggttgcaagacagagggttctagtgcacagacttcctgagacttagactcccaatggggatgtcataacttctgctgcctcctattgaccaaagcaaatcacatgatcagcttagattcaagaggatggaaacagaccccatcccttggtgggagttgctacacagtcagaaagcaaatggtttagaaggcctggatttagaaagggggctagagaaacagggttaagtttgccatcagtctagaggattactgagcatttccttttgaatgtaagaatctgaacttaaaatgtttgagtaatctggctaaaatgtttgagtaatctgggccgagagtggtggctcacgcctgtaatcccagcactttgggaggctgaggcaggcaggtcacgaggtcaagagatcgagaccatcctggccaacatggtgaaatgccatctctactaaaaatacaaaattagctgggcgtggtggtgcacacctgtagtcccagctgttcgggaggctgaggcaggagaatcacttgaacccgggagacagaggttgcagtgagccaagatcatgccactgtactccggcctggtgacagagtgagactccatctcaaaaaaaaaaaaaaaaccagcttgagtaatctggaagccaattatccacactaaaaaattatccacattaatcgggaagccaattatccacattaaaaacattaatggcaatttgcttggcaaaggcagactctgagtttgaggggtagggagtgaaggttctaggctgggatgcgcgtgtgtggtgcacatgtgtgtggctggtcctggtgtgggttccagatgaagaagcactccagcccatgagctccttgacaaccaggaggacaaacctggtttgtccttgcttagaatcccagtgcagacatggtgcctggcactgactaagagtatttcttacttatgccaacggtgatattttgaaacaaaacaccctggtatgggtggaattgtgtctcaccccttcccagttcatatgttgacatcttaacccccaggacctcagaatgtgactacatttcgatatagggtctttacagaggtaattaaggtgaagtgaggtcattagtttgggtcctaaccaaataggactggtgtccttataagaagagaagatcaggctgggtgtggtggctcacacctgtaatccaaatactttgggaggccgaagtgggcggatcacttgaggtcaggagtttgagaccagcctgagcaatacggtgaaaccccgtctctcctggaaatacaaaaataagctgggcatggtggtgcacacctgtagtcacagctgttcaggaggctgaggcaggagaatcacttgaacccgggaggcggaggttgcagtgagccaaaatcgtgccactgcactccagcctggcgacagagtgagactccacctcaaaaaaaaaaaaaattttttttttgagtaatttggaagccaattatccacactaaaaaattatccacattaatcaggaagccaattatccacattaaaaacattacaaattctcgctggagcccaaaagtttgaggctgcagtgagctgtgattgcactctagcctgggtgccagagcaagaccctgtccccaaaatagtaaataaataagtaaataagtaaataaataaaatgattcttggctttacagaaggattcaccataggatcacccagttacagaagcatcccagtgtgtctaagggatcactggcagggtattcactcctggctgggatcgaggagattggaagtacttacgaaggacagaaatgcttagaaacagagttaggaggccctgccaagcagccatcaatcagagaggaagatatgcctccctgaaattaagtccaaaggaaaacccagaactgacccacattctcagtgacagggtttttaaggtttatggtgtatcccaggaaatctatacatgttaaataacagaggtgggataagccctggtttgaggccaataagaaaagctctatctcggctgcaagagtcaagatttcaggccagtcactgtggctcacacctgtaatcccagcactttgggaggcagaggtgggaggatcgcttaagcccaggagttcaagaccagcctggacaacatagtgagatcctatctctacgaaaatattttaaaaatgagcccggtgtggtggcacatttgacctgtagtcaaagctacctgggaggcttaagcaagaggatcacttgagcctaggagttcagggctgcagtgagctacgattgcaccactgcactccagcctgagcaacgaagcgagactctgtctctaaaaaataaaaagatttcaggctgcagctgaaatgccacttcctcccaaagcccctgtctgggtcttcagccaaaagcaagtggccatgctctggtttctcagactcctgaactcctctccaaagtagtgcttctcacacagggccagtgcacgtgcccctgtgcgctttgccgtttgcggattgcaaaccgcatgagggcaggaagttactgggatcattttcccagcaagtgggaagcccaccatagacatctgtccattgacctccccgtgcccccttccttctaaatccctttgctttctgacttggtagcatctcctaccacgaggtggggtctgtttcccacctcttgaatctaagctgatcatgtgatttgcttcagccaataggagacagcggaagttatgacaaccccattgggagtctaagtctcaagaaggctgtgcactagagccctctgtcttgcaaccctgccattgccatgacaacaagggggaagcgctccatttgcttttggggaagaaactgagaataaccgcgttgagcaaagtacaacatccctcctcggcagccccattcctttaggaaagccttggaaagaagcagagatttatttacaaggaaataaaaaggtttgcatttataatgggctaggtaccatttaagtgggtgctgtcctcagcctgcctgccagggatgtgggagaggcagatggtgaaactgtgattggctctggaagctaaaactaatacaacactccctgcccaccccaccagctgaggtgcggcaccaaggaactcactctggggggatgtcctaaaccaaaccctggtttggtttatagcttgtttgaactcgactttgtccagccaaatgtttctcaacagctctgaaatatgtgagcacattccttgaatgctggtaatttagtcccaattgctacttgctggtggaacacagcaactgaaaataaacaagattcatacttattttcaagcacgttgcaatatgagcaaaattaactttggtaaacaagaccctcctgaaaaaagatcgagttggtagaaactgctctgtaccctgaaaactaattctgaggctgaaaagacccagtaatcaaaggcaagaatagcaattttcaggatggtaatatagcgggcagatcggagccgggccagggagcgcgccactctctcaggagtacaatacaatacgatgcaattaattttcctccaccatctttcatgtagaagtttaacaaaatgctctgcagctaattaccaacttcctatgcaaatataagcagagtgtgtagtttgcaattcatcaaatggatacagtgagaagacaccctagaagacacagagatggggagatggcccaaggagagtgttgatggcaccattaaccaggagctgttggtctcctggagggggcaatgtaggaaccagtgggggtctgggtatcaccaggaagctgagcacagacaggccaggatgccctggtgagaatgaagaatcagacatctcatggacacaaagaaggagtcagaagcaaggaagagatgccagtcctgatagggggtgtgtgagatgctgagctggttctggagggggtcgattgaaattctgatgtggacaagatgccaccaaggtctgtggtgacagcagatggaataggcatgcatgtctggatgaacatggaggtgaatgggtgtgggtgtcccgggatagggggcctgcagtgggacagtgcagagacgggggacaatgatgggccctagagagtccctggaggtggtagtatggaagcgggggcagagaagtgctgggtagagaagggcagtgtccctggcaaaagctccacccttggacctgggcctacggacctgaatgaggacaggtatttctgttttcacactcgaaaagttgtcttttggcccaccacgctgcccatcctgtgcccataaaaaccccagaccctagcgagcgcagacacaagtagctggacattaagaggagcagaatagcacaccaacagacaccagcagacgctggcagccagtgacagcagaactacgctgacgccaaggggaatttggccgggggtggctgcaggagagtccggctgctgggtggcctgactccaggaaaagaccaccttcccactccattccccttctttttccctatccatcttgctaggagccacctccaccactcaataaaaccttgcatccagccgggtgtggtggctcacgtctgtaatcccagcactttgggaggctgaggtgggtggatcatgaggtcaggagttcaagatcagcctggccaagatggtgaaatccccgtctctactaaaaatacaaaaattagccgggcatggtggtgggcgcctgtaatcccagctacttgggaggttgaggcagagaactgcttgaacccaggaggcggaggttgcagtgagccgagatcatgccactgtactccagcctgggcaacagagcgagactccatctcaaaacaaaaacaacaacaacagcaaaaaaccttgcacccattctccaagcccatgtgtggtctgatttttctggtactctaaggcaagaacctgggatacagaaagtagcgctctgtccttgcgataaggcagagggtctaattgagctgatgaccacaagctgcctgcagacagcaaagctgaaagagtgtactgtaacacacgcccactggggcttcgggagctgtaacccctcaacactagatgctgctgtggggtcagagccccaaaacgctccccacgaactgcctgtctgtatgctcccccaggggtttgggcagcggggcaccaaagaatcgagccgtactcctgtcacaatgccctgagagggggataagggaggttctcctgtttcagtgtcatcagtgaccctgtcccatccaacaccccttcatgttcctgacatcagaggaagacacaatcccggagttggagaagaggaccaagactgaactgggaattttaggtgacaatattctaatgacatgtcaggggtgacactggtgggatcctgaggtcaccaagtgatagatgggagcggtgaccagagctttacagcctacaaaggactcttagtggtcaggaggcaggcaggtatgaaggccccttgtcccttgtctcatctccaggccgacaaaatcagggctcagaatagaagactcattgggaaaaacatgtacaaggctgattcaggaattcaggtccctgattttaaatccagggttcttaggatgaaaacaacttccagcttaaacctgataaattgctctgaaatgaacccaatgaaagcaaaaatagaaattaatatacgaaaacccgagtgtgttcagaatgctaagcattctggaaataatagaggaaatcagtcaaatcagttgttggcatcttatagatcaaaaaggaaaaaaaaaaaaaaaaacaagaaagaaacaaacccaaacagaaacccaatgaatgaagtgatattttccctccgcgtcagctgttttggtgtttttgtttgtttgtttttttcagagcccattgtcaggagagcatagttctgactaatgtaggtttagcccatttttgtttcagaaattgtaaagaggatctcagagattcacggatggaggcctaggggtactgcctacttacctgcaaaccagcaaagagatgatacaggctcctacctcaacacttcaaagtccttcttctttgaaatagctgaaagatggagccaaaagcacgtgagagtcaaggtcagacttagctaatctcccgcaggtaatgcctttcaccttcataaagagaagaattacaacactgtcttcccgcatgtcctcagctgatggccagagaagaggaagataatatttactattttgtccttacaaaatgcacacagatgccgaccgtatatttgaaaagcaggggcttaatattttgagatgaggtgtgggaccgggaaaatgtggacgatctcaccttattcatttatctaaatttgacagtggaaccttcttccacagaactcaatgtcacacccgcagaatgccggggcgtgaaacaaggccactgttaacacgaggaagaattacttacgatgtattaacaagacaaaaaagtcaggagaagtggaagaaaatgatgagactatcagcattagttcctcgctggctgagtttagtctgaaatgacagctttgcccgcaggctacaaagcaagcattcagagagattcaggagtggtcttgctttcaaattttgctgagctgaagagtgtcatttttcattttcgtgtcttagaagcccatgtccacaccttctcatggtagccttgcctgcctctctccctgagaaatgtctaggcttcttagattgcagcggcaaatcaaggtgggctcctcttacctgggggagaaagcctagactccaaccccagtggaagcaaccaccgtgccatcagggtgccactgaacagggctgctggctgcaggagacgtgggttctctcttttcaccttgaggaagagctgcccagccccacaccttcccctgtggaattctctcgggtgatgctgtcattgtcctaccctggcagaccctccttggaacaggtgtgtgctttcagccaccgagttttgccagaagctcaggaaatctgtatcttcacttgctggcattgacggatgatcctatcggtagggggaaaatgctatggtcatgcactgatgatgtggtaggaaagaatttactgcataaacatctactttctgagaagggctgggaacagaaggccacagggggtgagaggggtttcttctccctgtcagccggctcttagtttgacctgccattcagggcttggacacaaaagacaaaacaagacaaaacaaaacaaaaacactcagagctccggaggtctttgtctcatgtccatggccatgcccggagccaggaataggagcaagctggtcattctgaccccagaccctgacatggggtaagcttccttcagagggctggtgaaagctttgtcttggtgtggcaggaactaagaatgcaaaaaagaaggagagtgaggccagatgtggtggctcacgtgggtaatcccagcactttgggaagctgaggcaggtggatcatgaggtcaggagttcaagaccagcatgaccaagatggtgaaacccccatctctactaaaaaaaaaaaaaaaaaaaaaaaaaatacaaaattagccgagcgtggtggcaggtgcctgtaatcccagctactcaggaggctgaagcaggagaatcccttgaacctgggaggaaaaggttgcagtgagccgagatcgagccattgcacttcagcctgggcgacagagtgagactctgtctcaaaaaaaaaaaaaaaaaaaaaaaggagactgagtgattgccgttggtgcaatggaaccaccagaggtttctggcagagacagccaaagacctggtgtgtcctcccctggggctcctcaggccctggctctacagaaagaccagcatcaagcatgcctttgccctaggtggaggctttagaaagcagggtggttgctaagggcagatgccaagcactaatacctgctgtcctgccttcttaatagaccttcaccctcaaaccctttcatttttacaagactcctgcctgccgcagttcccatgttggggagccagtactcacgggagacattgttttaatcttatttttaatttttgtgggtacatagttgttgtatatatttatgaggtacatgagatgttgtgatccaggcatgcaattcataataatcacattagggtaaatggggtctccatcccctcaaacacttctcctttgtgttacaaacaaccaattttagtgttttgattactttttttttctttttttggagacagagtctccctctgttgctcaggctggagtgcagtggcatgatctcggctcactgcaacctccgcctcccaggttcaagcgattctcctgcctcagcctcctgagtagctgggattatgggcacctgtcaccatgcccggctaacttttctatatttagtagagatgggtttttgctatgttggccaggctggtcttgaactcctgacctcaggtgatccacctacctctgcctcccaaagtacagggattacaggcatgagccaccgtgcccggcctcttttggttacttttaaatgtacgaattatttttgactacagtcaccctgttgtgccagcaaatactaggtcttattcattctttctaattatttttttgtgcccattagccctcctcactccccctcacgccccctcccactccctttcccagcctttggtaaccatccttctacttctctatctccacaagttccattgttttaaatttcagctccccagtgggcggctttcaagaagaccactaactgagtagagttcaagctggggcaagtcacttgacctcaatttacccatctgtacaattggagtgacagagcctacctcgcagggtggctgcaaatgtcagaagacaccgcacgctggagctcagcgcccatgcacagggacaggtgaggggtgccgacagtgtcagcgaagggtctggggaccagcaggaagcaggaatgatgggatgtggtgggaagggaatgattctgctgaaagtggggaggcaccagagggtacctcgttagcagcttgaccgggatcatggccagctccaattggtctacacgaatggtactctgagggtcatttgtcatgcaagtaacccctgccctcccaccttctggcttttaatatattagcccgggaaatgcccggcaggaacgcaaaccgctggaaaagatctctgggttgcattccaggcagacggcagtggtacccactccccgtctccaccaggagacccctctggagggaggtggccgggtcaggctcagcttggggcagcgcattctttctcggtccactagggggacatttactaaatccccacaacctgcaaattccatccttgctgggacaaatggctccctcgtgtctctcaagacccactgctgtttgttaacctgctggacagccaatctcttatagctttcaggggacaggaacatatcaagttctttccttttttatttttttaaacagtgaatgtgaatgtactgcagatttcccgtgaaatgctccatcgtgggagttactaactgatgagtgcattcattcgttccttcattcatgcgtagggtacctactatgggccaggcctgtgcaaggctcttgaaggacaactgggaagaaaaatcagacatggccctattcttatggcacttacgattcagtgggaagctagacaataaccaaataattgcataaacaaatgtaaaaaatcatcaatttaggccgggtgctgtggctcacgcctacgatcccagtgctttgggaggctgaggtgggtggatcacttgagctcaggagtttgagaccagcctgggcaacatggcaaaaccctgtctcttaaaaaaaaaaaaaattatccaggcgtagtggtgtggacctgtagtcccagagtctcaggagtctggggtgggaggatcccttgagcccaagaggttgaggctgcagtgaactatgatggtgccattgcacttcagcctgggaaacagagcaagaacttgtttaaaaaaaaaaaaaacaaaaaacaaaacaaaacctcacaaatgtatttatcttttgagacagggtctcactcagttgcccaggctgcagtacagtgacttgatcagagcttattgcagcttctaactcctggaccaagtgatgctcccatttcagccttttgaatagctgggaccacaggtgtgtgccactaaaagattgttttctgtagagaaggggtctccctgtgtcccggctggtcttggactcaagggatcctcccacctcagcctcctaaagtacggggattacagatgtaagccaccacacccagccacaaatttctacaaagaagagttacacagtgttctcacagtctacagtaggagggttggactcgctcaaaaggaggggagcttctctgaggaagtggcccaaaagatgagagagagtcaattaggtttttaaaaaaaaaaaaaaaaaaaagccatccaggctggggaatgagcatttgcaaaggccctgtggcagggggctcatggcaagcaggaggtcagagtggaaagggaggggcgcagggcaagaagagatgtggagggggcaagggccaggcttggagggtcaagttaagacactttagtctttatcctaagagtaatgggaacccctgaaggatgtaaagggagtaacttggtcaaatttgtgttttagaaagaccagctggggcatgcctggtggctcatgcctgtaatcccagcactttgggaagctgagtcaggagaatcacttgaggccatgagttcgagaacagtctgggcaaaacagtgagaccccagctctacaaaaaataattagccaggcgtgaaggtacacacctgtagtcccagctactcaggaggctgaggtgggagaattgcttgaacccgggagttcaaggcttcagtgagctacaatcctgcccctgcactccagcctgggcgacaagagagaaaccctatcttaaaaaaataaaaataaaggccaccctggctgctcgcagggggctggactgcccccaccacatggccctgcagaaatgaaggcctagtccctgggtggtgggagggctgctggcagaaagtcccggctccccatccttcagggatagtggctgtggggaacgtgctggctctgaggcatactccattccaggacagccagcagctgatgcatgatcaacgaggggtaaaaaggcccagactcagctctgagggtctccccaccccatttccagattcccttcagggttgtctgaagccttcacggaggctgcctcaaagctcaatatccttcctgcctaattctgtacttttcccttccccggatgccagtcctaagagaaccccttgacagatctcctgcacagtctcctccctctctgagtctgcttcctggggcacccacccctccaccctccggcaggagaagggatcagagacagtacagagtggaggaggggatgggctctctaagtcagatggagcgagctcacggcctgcactgggtggtgacggaagagacccaggcaaggagggcgcctgtcagggctaaatcatgtccccacaaacgatgttaaacctccaaaagatcatgtcctaacccccaatgcctgcaaatgccatcttatttggaaacagggtctttgcagataatcaagtcaagatgaggttcttagggtgggccctaaaccaagatgactagtgtcttcatgaaaagggaaatttggacacagacacacaggagagcacacgtgaggatgaaggtggagatcagagggatgcgtctacaagtcgaggatcactgcagattgtggagaaccaccgggagctggggagaggcctggggcaggttctctgcccccagaaggaaccaaccctaccaacaccttgatcttggacctctggcctccagccccatgaggccatacatttctgttgtttaagttgccctgtttgtggtactttgtcgtggcaggcccagcatactaatataggacccaagaggtagctggggaaagattgggcaaactgtgtgcatggcatcattactcaggtcaaaaatttgaaatgaagctcaaacttaaaaatattggtaagtatgaaaaaaaaagcatgataaaaaaaaaaaaaagaaaagctattgctgctaaaggaagaagggtagggtttccccacctccatcagcttgcaaaaatgaggctggtgacgtggctgtgggtctcatttcctgcacggcctgttggggtttgtgtagtttctgggcactcagcttgagaggctgacctcccaaaggcattgggagcctgcgggagccagccagggggagcacagctgtgcagccatgcctgtttgtcctgaccctacagcaggacgcaggcgccccaccacccagaaccccagaaccggatgtaggaggtggtgagagctgcattggttgatttcctattttcttccttcctatttttttttttttaattttttagagcaaggtcttgctctgttgcccacgctggagtgcagtggttcaatcatagctcactgcagcctctacctcccgggctcaagcaatcctcctgccttagcctcctgagtagctgagaccacagatgcatgccaccatgctcggctaatttttaatttttttttttttttttgtagaaaaggggggtcttgctatgtggctcaggctggtctcaaactctgaagctcaagtgatcctcccacgttggctgcccaaagtgtggggattataggcgtgaggcaccgcacctggcctgatctcctatttcagtaatgtatcacctcctgtgcaaagaaggaagattgttgcaaattaaacataaaaacatgaaagcttttcaagctgggtatctaagtagccttttcattcccaccaactccatgacagattcctatatgtgttgtgcataaccattattaaaataacaatatcgccctgttggaagaattcagaatgtcactagaacattctaaagataaaggccaaaaaaaacccaaaccccccccccacacacacaaaaaacacaaccaagctttatctttggaacagaataaggttaaaaaaaattaaaataatcacaaaggtatgatttaatctttacaatgttataaatattaatatgaaaaagactttatattgggaaacattattatacagtataacgctaattttatgaaaatcaattcatttagtgctcatacattttttacctctctctttggcttttgctgacgatttacgtcttatcattttctacttcaacacctaccaccttgcactggggtacagtgcaggatttggacatcacaattttttcttcagtaatgccccaaggtttcccacagataagaggagaaggttggccaggtgtggtggctcatacctgtaatggcagcactttggaaggctgaggtgggaggatcacttgagcctgggtgtttgaaatcagtctgggtaacataatgagacctcatctctattaaaattaaaaaactagccaggcatggtggtgaacacctatagtcccagctactcgggaggctgaggcaggaggatcacttgagcccaggaggttgaggctgcagtgagccatgattgtaccactgcactccagtctgggccccagagcaagatcctatctcaaaaacagcaacaacaaaagaataggatgttgccaaaataggacaaacaactgagctgaacgttggatgtttttaatcataagcatggcttgatttacatcactcccttcagaaatgcaaaggcttcagacatcgagccaaaggcaaaaccattgcaggtatgtggggccgggagagccccagcgaagtcagcttggtgcccactccaggcaggcacagggccagccctgctatgctccttatctcctttaatcccctagcaaccccagaaggtaggtttgtgatgatccacactctgcagatgaggaaactgaggttcaagagagttactaacttgcccctggacatgcccctgggaagtggccgggatgagttggaaacccatatctacttagctccatggtccggctctgtgtgcactaagacatcaattaccccccgggactggaaaccagaaggaggcgggcaataggttgtgtttgctgacggatcccacccagaactgatcctactggatctcccttagggagactcaggaatcctcactacagtgaattacatgcacagttttggtggccagaggggcatttagatgatggctacaggagtgcttttttgaaagcttcattaactatacaagtcaataccctattgcaatttccatgaaatgggtaattcggtgaagttcttttttaacaaaatgttgcatcaatgagggaattcagggtgggagatcaacaggaagttacagttggaaccaatttcaacccacatagaaagatccggaagccttgcaaggagaccatcacagtaatccggcgtgagagtgccgaggcgtagctgctggaatcatcgcccatttttctaatttgcagcctaggagctgatcgtgcaaccctgttagggagctaatataggatgaagatgggacaagttggtgtcgagagtaacacgccggctccttagcggaggtctgaagaacaatcgagttgaattaatttctaagagaccccatgacagattcttgatgatgatccccaattagggaaacctcggtttcgtttttgtttaatgtcaggaagttaagaggctgtgggcggatggctgtgaaagacacggagggtgaaagccttgcctctcttgaaacgtatggggccgtggctgcaggtcctttcatgccttctccaaagaggaagtcgtgaaatctgtgtgtctcagcccatgtccaaagagggaaacgctgtgatgagaagatacagcggttcaactcattctggagcccacagaggcttaaaagagggggagaatctgtttcatgaaaaagggaaagattcagtcttgaaccagatgaatgtgcctgggtgaaaatgcgtcagtggtaccagaaaatccagacagaatccttcctctgggtttttcccaaatcaacaagtgtctttggttgctgggacgcagggagagagctgttcatggaggagcgtgggaggtcacattcttgaggcctgtttagtttatcctgttaaaaggaggagatgtgaggccaggcacagtggctcacacctgtaattccagcactttgggaggccaaggcaggtggatcacttgaggtcagaggattgagacaagcctggccaacatggtgaaatcccatctctactaaaaataaaacaaacaaacaaacagaaacgcctggcgtgttggctcacgcctgtaatcccagcactttgggaggctgaggcaggcggatcacctgatgtcaggagttcaagaccagcctgaccaacatggagaaaccccgtctctactaaaaatacaaaattagccaggggtggctatgcatgcctgtaatcccaggtactcaggaggctgaagcaggagaatcgcttgaacccaggaggctgaggttgcagtgagccgagatagtgccattgcactccagcctcggcaacagagtgagactccatctcaaaataataataataataataataataataataataatacaccatatattagggaagagatttttgttttttttttaaaccactttcagtctcttgatatctcattgcaagtaaataaccaaagtacagcctggtctggacaggagatcacctcaatttggggcagctcacacaatacagtctaaaatgtggatgttgctgggggcgacctcattagtcaggcagtcacccctgtgagagggcgatgcgtcccactgccaagacgctcaagtaccaatatggaatgccagtcccttaaaagattttccctccctacgtccctgcgaaagagaggctgcctggataatagtctttcaatgtgttgtgaaaaaaaaaatagtgtttctagcaaaagtgttaaagttttatgggaaagtaaattactgtctacctggtatagatgcttttcgcgatgtagcaggcattaattacacatctgaatgtgacaagatcagtcttcggtttactgaattgaagacggtctgctcaccaggagggggttttcctgaatatcatcagggttcctcctcctactccatgtccggttttactgtgtactcctgggatgggatctgaggctggaaagagctagaaaacccctccgagtccccccagagagatggtagcctgtacacccaggtggattttggtcactgaaagaatcagtcttctttttttctcatcttaaaatatctggacaaggaagtggctaggattattgtgggagaaactagctcattggtggttctgggatatgaacccaggattctcggccagcattccagcaacagggactgatatgctttggctgtgtccccacccaaatctcatcttgaattgtagctcccatcgttctcacgtgttgtgggaggacccggcgggagataattgaatcgtgggggcggtttccccccatactgttctcatggtagtgaatcagtgtcatgaggtctgattttataagggggaacctcttttgcttggttctcattctctcttgcttgctgccatgtaagacgtgccttttgccttctgccatgattgtgaggcctccccagccatgtggaactgagtccgttaaacctctttgtctttatgaatcactcagtcttgggtatgtctttatcagcagtgtgaaaatgaactaatacaaggaccttcccaccctgcactccacaaacacctttcagcaggcttttgtgactcccaatttgaaagtgctgcattcgttcctgatgtgaaatgatttgcgtataaaggtaatacaaatctgaacattgcttttttgcatctcacagaagcagaaacattcttctagaagaatatgcaacggcagaggataaaaatggccttttgagtctttcagtcatgaaaagatctccccaccaaaaatacatgagacctcttaccctagaacagtgtttcccaaagtaagttcagtgttggtcacctgtagacaggttggcttccaataccctggctcttgaccctggaattctcctggatcacatggtcgtggaatgctttggttgtaagtatgccttggtgcctgtcttccctgatacatgcaagatgtctaagaatagaggctgtatctattgcgttcattatcatcattcccaggatccatcatggtgcctgccacaaagtagatatatgatattttgggattgaaggaaggagattctacatggaaaaaaggttccatggtcaagtacattaggaactagataaaaagccttccttttgggggctcacaaaacaccactggataagacacagatggaaaaaaaagaaaagcaggtgtttgctctggctttttgtcattcttgctgcaggacttatcagaaccttgaatatgctgatgtgtatggtatcatctccaagataaggctgcaatgtgcagtggcccctgaagtcacttgattgtgtagcctcctctcctgggatactcagtaacattcaaagggagcagctggtaggaaggcctggagaaacccacctaacggacccctgaattacagggatagccaaggcagccctagagaggccaggctgctgggaagggcaccagatagaagcaatctacagacagcccagaaagctgtcattccctcactcaatcagcagatgtttctatttctgttaaaacaggatcaattcattttccaatcataaaaataacaagtgtgtacagaagccccatgcctgtcttgttaagcattgaatcctcagtttgacaaatatttgctgaatgaataaacatataataaatggtaaagtagtattacaaagagaatacattctgctatcaaaccatcctgagcactttcttctgtgactacttaccataaataaaaattccgtggcgaaccttattaaaaatataccggggccgggcgcagtggctcacacctgtaatcccagcacttcgggaggccaaggcaggtggatcacctggggtcaggagttcaagatcagcctggccaacatggtgaaacctcatctctactaaaaatataaaaaatttgccaggcatggtggtgtgagcctgtaatcccagctactcaggaggctgaggcaggagaatcatttgaacccgggaggcggaggttgcagtgagccgagatcgcaccattgcactccagcctgggcgacaagagcaaaactccgtctcaaaatatatatatatatatacatacacatacagatgtatgttatggcagggatccccagtgcctggaccatggactggaactggtccatggcctgttaggaaccgggccgtacagcaggaggtgaccagcgggtgagtgagcgaaacgtcatctgtagttatagccgttccccatccctcacattaccacctgagctctgcctcctgtcagatcagcagccgcattagattctcataggagctcaaaccctactgtgaactgcgcacgcgagttctaggttgtgcactccttatgagaatctaatgtctgatgatttgtcactgcctctcatcacccccagattggactgtctagttgcaggaaaataagctcaggtctcctactgtttctatattgtgttgagtataactatttcattgtatattacagtgtaataataatagaaagaaagtgcacgataaatgtaatgcatttgaatcatccccaaagcatccccctaaaaccacccccagtccgtggaaaaaactgttttccatgaaaccagtccctggtgccaaaaaggttggggaccattggattttggattcatgggcctcactgcagaactattgaagaagaatctgacttttaaaggcctccagtgatagtgcttccagagtccttggtctgagagccagagagatctgagttcaaaaccaggctctggcatttacaggtactggagtttgggtggggaacaatgaggtagttggctatcagcataagcttcttccagcagagggttaagctcagatacgaaggagaagaaggaaccaggcaagggaaggttggggtatattggtttaggctcccctagaagcagactttgagccggaagtgggagtgtaaataagtgtatttgggagaggatcccaagaaacaccatcggaggagtgggaaatgagggggaagaggagcagtcattgaagggtgccgggtaaaacacgcatcttggattttggttgctgagagagtcagtcttttttctcatcttaaaatatctggacaaggaagtggctaggattattgtgggagaaactagctcatcggtggttctgggatttgaacccaggattctcggccagcattccagcaacagggactgatatgttttggctgtgtccccacccaaatctcatcttgaattgtagctcccatcattctctggggcttttctccaccagtccctgtaagcctttgctaaggaattacgggtgtggttggggctggagggcgcctccattccctgtcactctggtagcaaatggtggcctgagaacgttctctggtataaatgtggtcccagcggttggactctggaagcctgtgttcactgaaggtcatggaaagggggcagcatctattacagggggcaggagtactccatgctaaaggattcgaagacacaaaagtcctaattggccaggcatggtggctcacgcctgtaatcccagcactttgggagtctgaggcagatggatcacctaaggtcaggagttcgagaccagcctgaccaatatggtgaaaccccatctctactaaaaaatacaaaaattagccaggcatggtggcataagcctgtagtcccagctactcgggtggctgagatagaattgcttgaacttgggaggtggaagatgcagtgagctgagatcgtgccacagcactccagcctgggcgacagagcaagaatctgtctccaaaaaaagaaaaaaaaaaaaaaaaagaagtcctaattaagagtttgatgtgttcaaggaacaaaaagaaggtcagtgtgactagaccgtggagagtgatggggagaatggtaggagttaaggcagtggtgtgctgggaaatagttacaaccagctctaaaaaaagaaggagcactgatttgtcatgtttgtcaatttccatggtgtaaatactcccgtcatagccgacttcaagctgccaatgtcaaccctgaacacagagctgggaagagatgtgcacgttcacgttcagctcttacaagccagggcaagctgactccagcaaacactgcagggccggggcaagccgactccagcacacgctgaaggaccggggcaagccgactccagaacatgtgggacaagccgactccagcacatgctgaaggaggagttcagaaaggaaaatggaaaggtcagcctgggcaacacagcaagaccctgactctataaaaaatcttaaaaattagctaggcaaggtggtgctcacctgtagtcccagctccttggaaggggaccgctgtgtcttccccctctccaggatttactgcattgattggacgttccgaagccttgcagagtggctaccccaggacttggcggtacagcagtgagcaggacacacaaagctggcctctgggaactcacaggtccaagcgaagataaaagccccataggaagtggtgagatgggacagacacgctggcactggaggaagtgacctttctactgagtcctgaaaagtggcaaggagaagaccaggggagtggcccagagaaagaggctcacttgagcccaggagttcggggctgcagcgagctatgattgcaccacagcactccagcctgggtgacagagcaagaccctgtctcaaaaaaaaaaaaaaaaaaaggaaaatagaaagccattagaagtgttttaagcagaggatagaaggaatgatctaatttatgtctgtcaacgagctctgaggctggaaaacaatgggctgacctggagcatttcggcatagacctaaactctatccactttagaactttggtggtgggcaccccagacacacccggcttctgaagagcccagtttccgagcaaagagagagaaaatccctcgtcagaccttctcatgctgggccgagatccatgcttccatttagatagcattaaaggtcttctataaattaacaaaacaggaagagctgcaaataaaaatggacatgccacaccgccacgggcatgtgaatttcccagtggttcccattcgccggagtaagttaaagaccgtgtcaaccttaacacaagctttggtgacttttgtcagtttaagtaagacctttaatactccttaaacatatttttctgtaagtaatagaatcgtggcagagaaacgaagctatctgtcatggaaacgccggcaaaggaggaacaggcgtgtaataacaggggtgcctgactaccagaatacctgtgcaaatgaaaattgattttctcgagaattcttcgcctgatgaaataaattaaatctacatttacttctatttgtttaaaaacctctttgttaaaataagtacagcagtatatagacataatccaataaattagaggaggataaattatacccaagaacattctgcacagagaatacacacacagaggggacccacagaaggaaggcctgtgaaaaaccacttaaatgtttggcttaattccatttgtaatggtaaaactgacaaacagatacgtttgggtttcctagagcttgttttatttttttccaaatcagttttattatgattttaatttggaaaaaataatctacagagtttccacttagcctgaagaaatacaagtttaactaggtcttaaaatttaacacagcttggaaagtgcgccagtaggaacaaaaacaatccctaatgagaggaaacaacattacaagacttacatgaaaagacattatctgaggcctcatcttcctgcctgagcctgccatcctgcctctgagactctcactttcccccaacaaaagggaaatgttaaaagcacagagggggccgggcgcggtggctcacgcctgtaatcccagcactttgggaggctgaggcaggcggatcacaaggtcaggagatcgagaccatcctggctaacacggtgaaacccccgtctttactaaaaatacaaaaaattagccgggcatggtggcgggcgcctgtagtcccagctactcaggaggctgaggcaggagaatggcgtgaacccgggaggcggagcttgcagtgagccgagatggtgccactgcactctagcctgggcgacagagtgagactccgtctcaaaacaaaacaaaacaaaactaacaaaaaaagcacagagagtttattgagcatcatgtaagggcctggcacttgtttgtttgagatggaatttcactgttgttgcccaggctggagtgcaatggcatgatctcagctcactgcaacctccacctcccaggttcaagcaattctcctgcctcagcctcccaagtagttgggattaccggcacctgccaccatgtctggctaatttttgtatttttagtagagacggggttttaccatgttggccaggctggtctcgaactcgtgacctcaggtgacccacccaccttggcctcccaaagtgctaggattacaggtgtgaaccactgcgtccggtgctggcacttgttatattaggtgtgcctcccagggcggtgctgggagaggtgaggtggaagctttttagtgattggctacatttatttatttatttttgcgaatttagttttttttttttttttttttttttttttgagatgaggttttgctctcttgcccaggatggagtgcagtggcatgaactcatctccttgtagcctccatctcctgggctcaagtgattctcctgcctcagcctcccgagtagctgggaccacaggcaggcattatcacatgcagagatttttttttttttttttttttttttgtagagacaggggtctcactctgttgctctggcaggtcttgaactcctgggttgaaatgatcttcccacctcggcctcccaaagtgctgggattacaggcatgagccagcatgcctgtaaactggctgcatttactcacgcactattgtcccatggcagggtactggtgggtgcacagaaaaatgaaactgttgtcactgtggttgctctgatgtcactggagactgtgagaaccacacaataagggcagctcatgttgcattcaaacgcgtcaaggcaggtgcgtcaccccaggctctgagcacacacctcatttcatcccgagccaacactgctcccatttgacagatgaggacgttgaggcctaaagtggaaaattatagccagcaagtctgactccaaagcccgtgtgcccacatggcctttctgtcccattgctggaagaagccgctgaaggcaccatgtgtatctttttccctaaggattttcttgttgcttttaaagggatggtaaaagtgaacagcttgagttctgtttctaccaagtatgggtgcttacttcccaatccctgtttttgacttctgctttttggattccttctgagctgttcatagaaatgggaacattatgtactcttaacttccaagtcgagcccagtcagattggtgcatccagaaacctaacatcacccagcgtcatctgaagaacctgcaacttttgagtttttggaactgaaagcagactaggagctgtgcagagctaatggcctcctgcagaagccgaacgactttgttacattaggtgtctccacaccctgaccccaatccctcacccttctcctctagtacccctgtgtcttccccatctccaggatttactgtgttgattggatgtttcaaagccttgcggagtggctaccccatcccaggacttagctgtacagcagtgagcaggagacacaaagctggcctctgggaactcacaggtccaagcgaagataaaagccccataagaagtggtgagatggaacagagaccctggcactagaggaagtgacctttctactgagtcctgaaaagtggcaaggagaagaccagggtagcggcccggcaaagatgtagatttgagaaagagaggaattgctgggtgctctggagtcattccatagggttggaggagtgggaagaaggaatcccagggaatcaggaggatgctttgatgggtcaggctagggaaattgagcagcctttctcagcagggcaaaggggactcacggaggcttcaaagcaggggaggacttggttggatttgcgttttacaaagactttagaaagatgtctcttccattattaacaggccactccatgccagcctcttgtgaagggcctgtccaatgcatcagcccccaggtgctcaggctcaaactcagggttcatctttccttcctgtctcctctccctctgcaagtgcaattcagggaattagcaagtcctgagacctcaccttaaaatttcatccccatcctggtctgcttctccccaccccacaccaatgccttttcaattcctgtggcagcctcctccctatctacctgccttcatgtgtccgccctccgctcctcccactgcagcccatgggcctcctaacatgaacatccatccctttgctcccctgcaggaagccccgccctgatctcctgctgctcccgggatgaagcccaagccccttctctggccccaggggtctgtgtggcctggcttctgcccaccccaagccacattttcctgcccactccacccgaccttcccactctggccaccggagcctccatttctccagtggccatgcccttccctgccctcctgacctggcacatctgtttgttttgttttttgagagagtctcaccctgttgcccaggctggagtgcagtggcatgatctcagctcactgcaacgtctgcatcccaggttcaagcgattctcgtgtctcagcctcctgagcagctgggattacaggtgtgtgccaccacgtccaggtttttttttttttttagtagagacagggttttgccatgttgcccagactggtctcaaactcctgagctcaagcaatctgcccaactcagcctcccaaagtactaggattacaggtgtgagccaccacacccagccactttttgtttctcttttgaaatggagtcttactctgtcactcaggctggagtgcagtggcaggatcttggctcactgcaaactacgattcctaggctcaagtgattctcatgctcagcctcccgaaaataacactcacttgaccactcccccatcaagatgtagagtctaattcttttcccttttaacttggctgggtcttaaggacttgtaagcaatagaatatgatggaagtgatgccatgtgactccaagcctagatcaacagaggccatgcagtgcccacctgatttcttggaatgcacactctcaggacacccatctcagtacccctgctgggctctcagccaccatattgtgaggaagcccaagccacatggaggggtcagtcttcaagactttccagcccaggggccagacatgaggagagaaacctctcaatgattccaaccctaggcatttaagccacctcaaatcacctccccagctgaacccccatacttcagggagagagacaagccatccctgctgtgctctgtccaaatttctggcccacacagtctctgagcatatacaattattttatatccttatgtttgggggtggtttcttacataccagtagataactgtaacagctggctatgaaatacccattccccacattccctctcccttgctaaaaggttttgtttgaggtggccatgtgcctagctaaatactggctctcccaacctgtcttgcagctggggtggccctgggacacagtggaagtctctgagaaaatgctttctttcctgtgaagagggaacagtgcagcttgtaccctctgtccctcccttttctgcttagaatgagaacacagtggcacagtggctggagctgcagccatcactctgtgatcttgagggaaatgtgggtttcaaagttaccaagtggctgattcaacacagggagctatgactcgacctttctggttaggtgagaaaaataacccccttttggtttgagcctctgtagccaggattcttgttgatcagttccacgtttctcatgtatgctacacttgtattctcagaagccatctccccaccagaccacaagctctgtgagattagggacagggtctgttgtgttcaccatcacatgccctcaccctgaggctggtacattggaggttttcacgtatttgttgaatgctatcaaattctatcaaatgctatcaaaggacactgaaggttttctaggtggttagacacagagtctcagagacatttccagcctgacaatttcatggatgaggaatctccaggaggaagggttgggtcagggtttctcagtctcattctggcacctgttcccaaggtcgccagggtccctggaatccttacttctctgtgcacttggactgggttgaggtggagaaatcgcctgccgttggaagcttcctctgcggcatttcttcccctggtattaacaaatgttaattggaggcaatgatcactggcctttcgtgtgccctttaggctaccgtaattctgtgacttcactgcaaaaaaaaaaccaaccttgtaattttacttggccttacagaaaaatccttagaggatgcattctaagacaagaggaagtccagacaattttttttttctcttttgcttgtggggttgattctgctctgcatacagatttaggtcgcacgtgtgaaatcgcgtacttattttaaaatggaataaacacgcagccggcttttatggccatcttcccccactgcatttcattctgacgtcctttggttacaaatgaccagtcacatagctggtctaacactcacactctttcctgtgaagagggaacagtgtggcttgcaccctctgtccctcccttttctgcttagaatgagaacccagtgactggggctgcagccatcactctgtgatcttgagggcttttagggcttggtgtacttgtgactttgtcatagtcagtaaaaagctactcatttactttcctttgcctggtggcctccaagttgtctgtgtgcattcttgggcataggtcggactacctttgggaggaacttagtttatagtttgaaacaaagatgataacagccctttcccaaaacaaacccccttcctgcctggggatgagagggcctttgtaggactaacaaattagccacaagattagaaataagggtttaggagtcacacaggcggaggctgcaagattctaagcctccccaaattgtttttggggataacgtcactattgtaaaacccaagaccagcgcttgagatactttgcaaaccctgcacttgatggatcagctggcaccacccagatcgatagactggctcatctggtcttgtgggccccacccaggaactgactcagtgcaggaagacagcttcaactccctatgatttaatctccttcctgaccagtcagaactccttattcaccggccccctacccaccaaattatccttagaaactccgatccctgaattcttggggagactgatttaataataaaactctggtctcccacacagctggctctgtgtgaattactctttctctattgcaattcccctgtctggataagttggctctgtctaggcagcaggcaaggagaatctgttgggcacttatagctttgtgtccttgggctatgttcttagccttcctgtgactcattttatccactgtacacagggatgtaactgaattgaggatgaattttttttttctttgaggcagagtcttgctctgtcaccagggctggagggcagtggtgtgatctctgctcactgcaacctccgtctcccaggttcaagcgattctcctgcctcaacctcctgaatagctgggattacaggcatgtgccaccatgcctggcttatttttgtatttttagtagagtccgggtttcaccatgttggccagactggtcttgaactcctgatctcaggtgatccgcccgtctcggcctcccaaagtgctgggattacaggcaaaagccactgcgcctggccaaggatgaactttgttaatgcgtgaaaggcgctgagagcaacacctgacacgcgttatatgaaaacaacaaattctgggtgtctttgcatccatctgagcagagagacggctgtgtctggagccagcccagggaggcaggaggcgttccctgacatgacatctcaacagtgtcttccagccttgatttctccacttgtaaaatgaaagagatcatatactagttagtgaaacctttggcaatctcagatgaaatgtgtgatgaggatgcagagtgttattgtaattccacgattacaatctctgcagagccgggaggcaggaggctggcgggataccactgcctacacacatacctgaggagttttctgtgtgtctgtgaggtttctattgaaaacaagattcacaaagggaaaatcaccaccagtcctggccccgcataaaagataacaaggagaagatagagcctgaaataccagggaggtgagacacaaagagtcagttaataaatccatcgaaagcccgtccccaaacactgaagccaaatttcatcttggaacactttgcataacaagcaatttaaggtaaggcggacccccgagagctacagaacgtttaaatgatgggcaaatatttctgtttggttgttaggagaaatgactttttgaactccagtctttgagtaaaacatgtttgaccagctataaacagattcaaactatttgcttttgcggggctcccatttcattttcatgaggttagagagtggcaggagatcacttcgtgagacaacaggttgtaaaggttgaagctggtagctacggtactgaattgactgaaaaatacaccacaacccacactgctgttgagcccattccgttggatgagaggacttgcaataggagtgctggcttccatccctgtctgcaggggaatgttggcaccagagatgaacagtgggccgttgggaatagagaattgcaattttttaaagagataagatcttgctctgttactcaggcatttgaaaatgcttctcaaaagacatcatgaagataagccacagaggctgtcatcccagaactttgggaggccaaggctggaggatggcctgtgctcaggagttcaagaccagcccgggcaacatagtgaaaccccatctctacaaaaaataaaaaaattatctggggatggtggcacatgcctgtagtcccagctactttgaaggctgaggtagacgatcgcttgagctcaggagtttgagaccagcctgtgcaacagagtgagaccccatctctacaaaaaatacaaaaattagctgcgtgtggtggcacatgcctgtagtcccagctactccaaaggttgcggtgggaggatcgcttgagctcaggtggttgcagctacagtgagctgtgatcacaccactacactccagcctaggggacagagtgagaacctgtttcaaaaaaattaaaataagccacagaatggaaagaatattggcagcacatgtatctgacaaaggacttgtgcagaatatgtagagaactcctacaaattaaccctgaagagaacaactcctaaaaaatgaacagaagatttgatcaggccccctcacagaagatctaagaatggccaatgaatacataaaagattcccagccgggcatggtggctcacacctgtagtcccagcactttgggaggccaaggtgggtggatcatgaggtcaggagagtgagaccatcctaacacggtgaaacctcatctctactaaaaatacaaaaattagccaggcgtggtggtgggtgcctgtaatcccagctactcgggaggctgaggcaggagaatcgcttgaacctgggaggcagagcttaaagtgagccaagatcatgccattgcactccagcctggtgaaagagctagactctgtctcaaaaaaaaaaaaaaaaaaaaaaagaaagattcccaatgtcttgagtcatcaaggaaatgaacgtgatcaccatggtagacacagtggctaaattttaaaagatcgacagtcccaaatgctgacaaagatgtggggaacatggacggctccatgctgctgtttggaacatggaatggcaccgtctctctggagtgctgctgattacaaagagcaacacgtacctaccctatgactcggcaattcccctttggtgtttagacaagagaaatgaaaacgtacgttcataaaatgacatgcactaggatatggatagcagccttgttcagaagaaccccagagtgaaaagagcccagatggataccatgcatctgggtccatcgtggtatgtttatgcagtggaatactatgcagcaataaaactactgatatgagtaatgatgtggatggttcttaaaaactatactgagactgggcacgatggctcatgcctgtaatcccagcacttcgggaggctgagggagcagatcacatgaacctaggacttcaagaccagcctgggcaacatagtaaaacctcatctctacaaaaaaaatacaaaaattaaccaggcattgtggtgcatgcctgtaatcccagctacttgggaggctgaggcaggaggatctcttgagcccaggaagttgaggctgcagtgagctgtgattgcaccactgcactccagcctgggtgacaaagcaagaccttgtctcaaagcaaccaaacaaaaaactatactgaacaaacaaagcaggagacaagagtataggctgcataaacccatttatatgaagcccagaacaaacaaagcaatctgtaatgatagaaagtggtcacctggggagagggaggaaattgactgaaaaaggggagaaagaactttctgggctgatggtggcatctaatctttgctatctgatatggtggccactaacctcataaaatgtgacttgaattgtggctggtatgactgagagactaaatttttaattttatttaatttttccttagaggcagggtcttgttctgtcatacaggctgcagtgcagtggcatgatcacagctcactgcagcctcgaactcctgggctcaagcaatcctcctgcctcagcctctggagaagctgggactataggtgtgcatcaccatgcccagctcattttaaattttttcgtagagaagaggtctcactgtggtgttcaggctggtcttgaactcccagcctcaatcaaccctcctacctcagcctcccaaagtgctaggattacaggcactagccacagcactaactgttaaaaattaacctccaaattgagatgtgctgtaagtataaaacaagcacaaagtttcaaagacttgttactgaaaaaagagaacaatttcttatcattttgtattaaaatcatgttttaaatacactgggttaaaaatataatattaaagtaattttcacttgtttgttttacttttccaaatgtggctcctagaaactttaaaattacatgtatggctcttgctccattgctatcagacagagttggtctgtgttttgtttgggtagtggctacctgggagtatgtaattatcaaaactcgctgaacggaatgcctaaaatccgcgcattttgtagtgtgttaattatagttcaattagaaaatgacacacacatgacccctgcttgactcagacacggtaatagaaattgggaggcagaagtgcaatgactgtgagggagaatgaaaggtgctgcaatgttctattcctttccaggagtttaactctaaaattgaacctagctttatgatacgttcaaggagtgggagtctgttgaatttaagaggcaaatttaggcagaacagctggctaattagtgtgctgccctgggagccattgtgttttacaagtgagaaggttccatagccccaggactggtttctctaagccctaatctccccctgagggcctggacttgccctactggagagggctcgactgactcctcccctgaagcagctcacacactacactgtctccccgtccctcagaccttgtcctcaaagaaaaaccccagtgccaacctgcttaggctcaagtgcattttcaggggagcaaaatcttttgaccaagaagatacctttccatctgctacaggcaggccaggagcctggtggcatgagggatgttgacttcctgaacccaggtggcaacgtggcaaagggtggggttaaccactccatctatctgccctgaccagggtgaccacagctttgggctggttcaggcaggaagcacagatgcatgctaagagtttccactgtgggtatggaggggcaggaagtcaggagtagtgggtgaggagtgggagaggaccctgaaaacagggttggatggatggttgtgcgaagaattgtggtcaacatcagctccatccccatctgattctatcctttgttgggggggggtggggagtcagacgtgcagacacagcttggcagcaggtgcagagaatgaccaaaaagcaaacacaatgaaagtgaaggtcatgagctttggaccttccagatgtgggttcaagtcatggctctggtgctagcaatgcaaacttgtacatgttacttaatttgcctaaatctcagtttcctctcctgtagaataaagacaatagtagctgctataaaggatgagttggaagttatgttaaatggggtgatgtcagctgagtgtttggtaaagggtatcattggttctgggtggtggctgtattctaatggggccctagccaatgacttttgagacaaaggagagaatgaagcccccatggagtgggtcagggccacagccaaggagggtgaggctcacagcagtgctcccattccagcagaaagccagagggctaatcagaaaatgggtgggctgctcatctatattttatgtcttaggctgtgttctctagaagcagatctttggggaagaattcatgtgaaagtgaaaatcccctggtagaaactgctcttaggaaaaactaattggaaagtagggaagcaggaccaggaagagaaggtggccaagggagggcacaatatcaagcaaagtctcacagagaaccatagtagccaccccaagatggcacccaaggatgctcccctcatggtatttctgcctttgcatatccctgctcccactttgaatacgatggacctgtttaacaacagcgattgtgaaacagatggagtgtggcttccaaggctagatcacaaaagactgcagtgtctcccttgctctcttggttcactcactctggacgaagccagccaccatgttgtgaggatgctcaagtagtctgtggagaggctgatgtggtgaggaactgaggcctcttgccaacaaccactccaacttgctggccttatgagggagccttcttggaagcagatccccctgtctcagttgagtcttgaggtgacgcagcccagctggcatcttgactgccacctcatgagagacataagccagaatcacccagctaagccacccatgaattcctgacccacaaaaactgtgctttggattgaatatgtcccccaaagtccatgtgttggaaacttattcctcaatgcaacaatgctgagaggtaggacctctaagaggtgattatgtcatgagggctctgccttcataaattaatgttattatcatggagtggggtttttatgaaagcaatttcacctccctctcccccctctctcatccttttttgccatgtgatgccttctgccatgttatggtgcagcaagaaagtcctcatcagatgcagacctttgatcttggacttcccagcctctagaaccatgagccaatagatttctgctctttataaattttcaagtctcaggtattctggagaagcagcacaaatttgattaaggcaccctcttagtggcattaatgcccaaagcatatgcatacatttccagaggtcagagccccctagaactttggtgcttagaaataggaatggatttctgaattcagaggtaacacgctgcctcatatcacacacttgcagcttcctttatgtaacgtaccttattgatttctatttaataatgactgatgcagctcttgggcctttacctgatgaatcaaagctgtctgtcaaataggagagatagggcaggagtgaagcattattattccaaagcacagtcattagattaatagtaagctccagcaacaccattaacgtggggagaatcgatgaaataacagaggcaaggctgcctccagataagatcactgcttctctagcatgtgtcctatttatagatcatatgtgttcactctacctttggctctttcttccatcgagggctcccaagtgagctgattataatctttaagactacgtgtcagcagcataaaccaccatcaccatcactccttatccttgacccatcgtcttccacctgcccaccaggaaaattagacaacactctgttgctttgttttggaacaaagacatttttcacaactttcccaaaagaaatttttgtctcaccatgatcaatcttttcctagaatttgggaaaataaaaactttaaggccataaatagtaaactttgaaaatcatttccccaaatggatttccctgtgcccttctgttcacaaacagttagctctcccaattcatagcttgtcagcaaagtgactttattttaatgtctttagtttttatcttctcgatttattattcagaataggtggagagaaggggggagaagaccctttctctggaaggtactcctttctgaatctaaggaaatgattctctagttctgtactagagagttgagtgagactaaagctggtggtgttaggaaggtgggcaaggtcgtcactgacagctctcttaagaatcttaagcatgtatgaagggatggacaaagaaagaccaccagtggatgaaacagagtctcagtgccatgtgaaaagtggccagccttgagagatcccttttagccatcacatccatccctgcaacctggacagcacctcctccactcaggacctcctccacctcctccactctgagatccaccccctgtccatggctcattctgaaccacaggcttcttccacgcctcactctgcctgccatcttggcttgaaccctcccagcctctgagctcactgatcatacattgattatttttctgtgtctagcctcatcttgcccttcggacttgatgctttgataggattccagtttttatcttgagctattattgacttagttcaacttccctcttggttcaactaagccacagcacatttcctctgccctcagtgtctgcccctaccccaagaagagtcatcttgcctttcccttgcctttccccacaaataggaccttaatagagagatatgggacctggagagagacatctagagtcaagtcagaacagattagagcaacctgtggcccaagctggcatctctttctcttggatgttctctgtgtaccgctgtccctcgataactttacacgtgtgaaggtaacatttaagaaaataattttcccccacatcccgctctgtgcattgccaatggtttctaatcagatggcttgaggtctcccctccacccccaattttcctttatgcttcatattagaactatggactttctactgatggcctattaaaatgtatcttttgattaaaatcatacagctcatcaccaaacatgccaagccatgataatacatgaagggtaaaacttgggcacgtaactcataaattctaaatgatgatgactccattcttctctccctttgaaaatttaagatcaaaatcctgtaaaagtggaaataatctgaatgctcaacaacagggatgggtaaagaaatggactcgccctagtaaacaattaatgatcgagttcgcaaagaccacttggtgactgctgcgtgaaaaagatgggatacgaagacctgtcttccatgtaagccccattctgcagtggcctgcagcctcacctggggcactggcctgcaggtctgggaccatctctatcttccttccaagtcttgctggggagggcaggccaagtcagttgtgagagtgcagtctcgatgatgttagaagcgtagggtccttagcaggacgtcaactaaggttgcagtgaagggctgcaattttaagccaggcgcaaggtggaaaaagcctgtggtgctggtgggtggtagagagttggtggtgaggaggggagtggggcaggggaggataagaggagagtggggaaccacagggatggagttggggaggactggtcgtccacaatcaccgtaatgagaacctgaactagcaatggcaagtctcctcaggagatggtgttcaagccctatctttactctttggagcctatcttgattgttttttaaatgtgatttttacagaggcacagaatgaatagaatctgtgtcatgctgacagttcacggggctgagttcctgtctgttccatttcgtgtcctgctgtgtcctaagcaggaacacacatccagcccacagagactggggagtgaccacagaatgggaggtggggtgtctgtggcaggctgtagctccctgggctgaggttcactggattaaatcaaataaacaacaaataccttttcttagtataaatatttgtattgactgtttctggcaaccatacctggacccttcatttatcagaagaaaagattaggttagaatttaccactttcatggaaggagggggagaggggagaggagagatgagaaaggggaggggagagaggaaagagaaaggagagagaggagggagggagagaaagaggagagggagggagggagagagggggatgttgagagataaagagagggggatgttgagagataaagagggagggagagagagagagggagagggaagaaggagggggagaagagagggaagaaggagggggagaagagagggaagaaaggggcggtgcagaaagacggagggggagaggagagagaaagagggagggagagagaggaaagcagggaggaagggaaagggagaggttaaaagagagattgagagaggagaggcttcctagcacttctctcctccgagcgcagagccctgttagaacagcctgtctcctttcatgaagcttctctgccaccttctctcccaccctcctgcatttgtcccttttggagacagcactggaatttacctggaatgagccttctctctgctccccttgcacacgggctggctgccagcagctttctccaccagcctccgacagaaaccctgcagagcttccattctgcgttcagccaccatcgcctcccacccagtggtttctaaacaatctctgagcaagattttggttttatcagcctattaacttctccctttttcattttggggaaggggtccaccaacattcatcttgtgctgaacaggagctgttttctgctcagctcttgttcttgggtgacctggcatggagggatatctccagaccttggggagtcgtcaaataagcctggatctgagaactgagggatgctaggggtgacatccacactcaggaggggtgaggcaaatgcccccttcattgtgttctcatgaatctggttcttccaaagattttgtttactaagttgcatttattaagaaataatgcttgttttgaagaatattattattatttttgagacagggtattgctccattgcccaggctggagtacagtggtgcaatcatggttcactgtagccttgacctcctgggctcaagcaatcctcctgtctcagcctcctgagtaggtgagaccacaggtatatacaccaccatgcctagctaattaatttttttttttttttggtagagatagggtcttgctatgttgccaaggctggtctcaaattcctgggctcaagcgatccacctgcctcagcacccccaaagtgatggtattacaggcatgggctactgcacccaaccaaaattattcttattaatcaaatatgtacatcaggcaatcggctcttccactagccagagctaagcagtgttttccatgaagtggatctgattccagttgaaggaatctaattaggctctgtattctaattaggctgagtggcatcaagctctgtaaaaacacaggggcttccattagacttttggaaatacagaggtaagactaaaagtcccattgctgtctgtatggatgctggggtggagcccagcttgggatagaagatgttagtgactctggaagacagaactccagaagaaaggcttaaaagccagagttattttgcagttgaggacttgaaacctccaccagtaagcacactattttggtacaactgagtgattaagttctaaggtttaacatccaacttactgggtgcaaatctcacgcttgccccttattagttatgtacccatgacctccctgaacctcagttttcccctctgtaaaatgaggctgataatactgcaacttgaaccagctggggtgcatgcggatgcaaagaacataaacactgacgcaaacggagacagcaccttgtatatttccatttctaggcagtagtggcttcatcatcacatcaaattattattattatttgagacagagtcttgctctgtcacccaggctggagtgcagtggcgtgatctcagctcactgcaacctccacctcctgggttcaagcaattctcctgcctcaacctcccgagtagcttggattacaggcgcccgccaccacgcccagctaatttttgttttttttagtacagacagggttttactgtattggccaggcgggtctgagactcctgacctcatgatctgcccgccttggcctccccaagtgctgggattacaaccgtgagccaccgtgcctggctgacatcaaattataatgtggttgtcaaccagaactgaagtgagaaggcaagcatgtgtcacttctggaaacccacacagaagctaaaaaaaacctcctttcctagaagcttccattaaaaccctcctcagggctcattggtctattttgcaaagctcatgtggtcatctctgaatccatcacagtctaggggatgagactacattggtcagattaggcctgagctatctaccccttctctagagccagaggtggagttagctccaaagaatgtgcctgaatgaaggttgggagactcacaaagatttaggaagataacactgcaaagcactagacacacagggagcactccataagtgtgagctaattactggccattattgtcatcctggtgaaatctggttaatcaagagtcttattctactgaaaatgtttatgtccatatgcctccatcatcctcaccatcatgatccccatcattatcatcatcctcaccatcttcttcatcatcatcttcaccgtcatgatcaccaccatcatcaccatcatcttcatcaccattccctcttcatcatcatgttcatcatcatcctcaccatcatgatcatcattatcatcgtcatcttcactggcaccatcgttggccaagtgcctactgtgtgctgctggcaccatttcagacacattgcaaacctatatctaatccttgggacaacttgtgaaacaggatatcactagttgcctacccccagtgcattctcccccttgttccttacgatataaaatcctgagatttcgcttaatgtggcatgataccaaagatctaaaacctacactaataaaaacaaacaaaacctactcatccagttgggcatgatgatgcaaaattgtgaaacagttagaaatagatgtaaaatgtcctatgcaatgaatagacaaagaaaaaaaaacccatacggtaccagcttcctttgcagttatgtgtggtcatgtgacataatctagccaatgagataagagaagtctgccagagacttctgagaaaacctcacctctctgctgcaggcaccatccgttcctcagtgctactttccttttcttcctgctcgcaacacaggccctcaaagctgtggaagagaaactctctcatgatcatgaaggagaaagacacccactaagaaggacaaaaaggggaagtttgggacattgaggctaccatggaccaattcaccagccctgggatgcatcctccagcacctcattatgtgttgaggggaagaaaggcaccctctttgctgaagtcactgaagttgggtttctgctgcagacaagtgaatacagcttctaaaaggagattgctggacaaaatgagccctgtcatagatgaagaaaccaatgcacagagagggaaagcatttactccaagtatgaaattcaggctcccaaaccaatgctcccaccttaaaaagcagggaaattctgacacaggctgccaaatggatggatcttgagaacatccatcttgagatggtgcaaagtgaaacaagccagtcagaaaggacatataacgtatgattccacttacgtgagggacttggagttgtcatattcatagagacagaaagtggaatggtggttaccaggagcgggtggagggagagcaggagtgagtggctaatgggtgcagaatttcagtttgagaatatgagaaagttctggagatggatggtagtgatggttgcagaacactgtgaatgtgcttagtgcctctgaactgtgcccttagaaatggctaagattgtaaggtttttgttatacgtattttattgcaataaaaacatatgatgtgggaaaactttactaaaaacaaaacaaggggcggagccaagatggcccaataggaacagctccggtctacagctcccagcgtgagcgacgcagaagacgggtgatttctgcatttccatctgaggtactagattcatctcactagggagtgccagacagtgggcgcaggacagtgggtgcagtgcaccgtgcgcaagccgaagcagggtgaggaattgcctcacttgggaagtgcaaggggtcacggagttccctttcctagtcaaagaaagtggtgacaaacggcacctggaaaatcgggtcactcccaccccaacactgcgcttttctaacgggcttaaaaaatggcgcaccaggagattatatcccgcacctggctcggagggtcctacacccacggagtctggctgattgctagcaaagcagtctgagatcaaactgcaaggtggcagcgaggctgggggaggggcgcccaccattgcccaggcttgcttaggtaaacaaagcaggagggaagctcaaactgggtggagcccaccacagctcaaggaggcttgcctgcctctgtaggctccacctctgggggcagggcacagacaaacaaaaagacagcagtaacctctgcagacttaaatgtccctgtctgacagctttgaagagagtagtggttctcccagcacacagctggagatctgagaacaggcagactgcctcctcaagtgggtccctgacccctaacccccgagcagcctaactgggaggcaccacccaggaggggcagactgacacctcacatggctgggtactcctctgagacaaaacttctagaggaacgatcaggcaccagcattcgcggttcaccaatatccgctgttctgcagccaccgctgctggtacccaggcaaacagggtctagagtggacctctagcaaactccaacagacctgcagctgagggtcctgtctgttagaaggaaaacaaacagaaaggacatccacaccaaaaacccatctgtacatcaccatcatcaaagaccaaaagactacaaagatggggaaaaaacagagcagaaaaactggaaactctaaaaagcagagcacctctcctcctccaaaggaacgcagctcctcaccagcaatggaacaaagctggatggagaatgactttgacgagttgagagaagaaggcttcagacgatcaaactactctgagctaaaggaggaaattcaaaccaaaggcaaagaagttgaaaactttgaaaaaaatttagatgaatgtataactagaataaccaatacagagaagtgcttaaaggagctgatggagctgaaagccaagctcaagaactacgtgaagaatgcagaagcctcaggagctgatgcgatcaactggaagaaagagtatcagtgatggaagatgaaatgaatgaaatgaagcgagaagggaagtttagagaaaaaagaataaaaagaaatgaacaaagcctccaagaaatatgggactatgtgaaaagaccaaatatacatctgattggtgtacctgaaagtgacaggaagaatggaaccaagttggaaaacactctgcaggatattatcaaggagaacttccccaatctagcaaggcaggccaacattcagattcaggaaatacagagaataccacaaagatactccttgagaagagcaactccaagacacataattgtcagattcaccaaagttgaaatgaaggaaaaaatattaagggcagccagagagaaaggtcgggttacccacaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccagcccagccctaaaagagctcctgaaggaaggactaaacatggaaaggaacaaccggtaccagccactgcaaaatcatgccaaatcgtaaagaccatcgaggctaggaagaaactgcatcaactaacaagcaaaataaccagctaacatcataatgacaggatcaaatccacacataacaatattaactttaaatgtaaatggactaaatgctccaattaaaagacacagactggcaaattggataaagagtcaagacccatcagtgtgctgtattcaggaaacccatctcacgtgcagagacacacatagactcaaaataaaaggatggaggaagaactaccaagcaaatggaaaacaaaaaaaggcaggggttgcaatcctagtctctgataaaacagactttaaaccaacaaagatcaaaagagacaaagaaggccattatgtaatggtaaagggatcaattcaacaagaagagctaactatcctaaatatatatgcacccaatacaggagcaccaagattcataaagcaagtcctgagtgacctacaaagagactaagactccgacacaataataatgggagacttttacaccctactgtcaacattagacagatcaatgagacagaaaagttaacaaggatacccaggaattgaactcagctctgcaccaagcagacctaatagacatctacagaactctccaccccaaatcaacagaatatacgtttttttcagcaccacaccatacctattccaaaattgaccacatagttggaagtaaagctctcctcagcaaatgtaaaagatcagacattataacaaactgtctctcagaccacagtgcaatcaaactagaactcaggattaagaaactcactgaaaactgctcaactacatggaaactgaacaacctgctcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaagagaaatcaggaaatatccaaaattgacaccctaatatcacaattaaaagaactagaaaagcaagagcaaacactttcagaagctagcagaagtcaagaaataactaaaatcagagcagaactgaaggaaatagagacacaaaaaacccttcaaaaaattaatgaatccaggagctggttttttgaaaggatcaacaaaattgatagaccactggcaagactaataaaaaagaaaagagagaagaatcaaatagacgcaataaaaaatgataaaggggatatcaccaccaatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggctctgaaattgtggcaataatcaatagcttaccaaccaaaaagagtccaggagcagatggattcacagccaaattctaccagaggtacaaggaggaactggtaccaatccttctgaaactattccaatcaatagaaaaaaagggaatcctccctaactcattttatgaggccagcatcatcctgataccaaagctgagcagagacacaaccaaaaaggagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaatgaatgtaatccagcatataaacagaaccaaagacaaaaaccacatgattatctcaatagatgcagaaaaggcctttgacaaaattcaacaacctttcatgctaaaaattctcaataaattaggtattgatgggacgtatctcaaaataataagagctatccatgacaaacccacagccaatatcatactgaacgggcaaaaactggaagcattccctttgaaaactggcacaagacagggatgccctctcacaccactcctattctacatagtgttggaagttctggccagggcaattaggcaggagaaggaaataaagggtattcaattaggaaaagaggaagtcaaatcgtctctgtttgcagatgacatgattgtatatctagaaaacctcattgtctcagcccaaaatctccttaagctgataagcaacttcagcaaagtctcaggatacaaaatcaatgtacaaaaatcacaagcattcttatacaccaataacagacaaacagagagccaaatcatgagtcaactcccattcacaattgcttcaaagacaataaaatacctaggaatccaacttacaagggacatgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcacatggcaccaaaaaagagccctcatcgccaagtcaatcctaagccaaaagaacaaagctggaggcattgtgctacctgacttcaaactatactacaaggctacagtaaccaaaacagcatggtactggtaccaaaacagagatatagatcaatggaacagaacagagccctcagaaataatgctgcatatctgcaactatctgatctttgacaaacctgagaaaaacaagcaatggggaaaggattccctatttaacaaatggtgctggaaaaactggctagccatatgtagaaagctgaaactggatcccttccttacaccttatacaaaaattaattcaagatggattaaagacttaaatgttagacctaaaaccataaaaaccctaaaagaaaacctaggcattaccattcaggacataggcatgggcaagaacttcgtgtctaaaacaccaaaagcaatggcaacaaaagccaaaattgacaaaggggatctaattaaactaaagagcttctgcacagcaaaagaaactaccatcagagtgaacaggcaacctacacaatgggagaaaatttttgcaacctactcatctgacaaagggctaatatccagaatctacaatgaactcaaacaaatttacaagaaaaaaaaaacaaccccatcaaaaagtgggcaaaggacatgaacagacacttctcaaaagaagacatttatgcagccaaaaaacacatgaaaaaatgctcaccatcactggctatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccactgtggaagtcagtgtggtgattcctcagggatctagaactagaaataccatttgacctagtcatcccattactgggtatatacccaaaggattataaatcatgctgctataaagacacatgcatacgtgtgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaagaatgagaacacatggacacaggaaggggaacatcacactctggggactgttgtggggtggggggaggggggagggatagctttaggagatatacctaatgctaaatgacgagttaatgggtgcagcacaccagcatggcacatgtatacatatgtaactaacctgcacattgtgcacctgtaccctaaaacttaaagtataataataataaaattaaaaaaagtctgtttgtatggaaataaaacatgtcatttgtgaaattaacaaaaaaatcaattcttccttcattaatgcctcagaaaaagtgtgttttgttctgtcttgccaagggtttgaaactcttgtttctatccctgtcctctcatcctaggctctcttggatccagtcaacactcagggtggctgaatgagtgcagttgaagtggcttctgctattggggcatgaacctctctgcccatggcaaggacttgggacaggtatggcttctactcatggcagttgagataaatgctgaatttctagagtctcaggagttaacagttacagggtccaagtcataaactcagaaatgaagataagtagcagccccagactgggaggactaggtctaacatttctccgggaatgaactatttccaaagtatatatattaacattcaagactcgctgaaaatactcacagtgctaccgaggtcctgactggggagattctctcccttcccctaagtgaaaatgtcagtgttcagcttcctgagcgaagtttgcagctcacatctcctctgacccagtatcactgagcatcttaattaggtgaaagggtctacatatctttctttctggacttgaggttgtcctctgtgttgctgtgtgtgagggttcaagctgtgagtcacttatttccttcttagcaggcgagggaattttgtatggaaggctaaacaaagacagtttctctccctggtgtttaaagcaaatctctccagtatggggacaggtagagaaagagacccaggcttatttaggacagtgattctcgatcctcactatctgtcccttagagtccctgaagaactttgacaaatgctgatgtccaagccaaacccacaatcaattaaaggacaacctctggggatggaacctaggcatgcgttttttttaaagtgcctcaggggattccaataagcagtccaatgtgagcaccagtgttttgcaatctgtgtcattccacttgtgttctgtggagcagcagtgcaagtattacctgggagctggccgggaaaacagaatcttaggtcctgctccagggctcctgggtcatccagatcacctggatcagaatctgcatgtcagcaaggttttcagtagagctatgtgcaccttagagcttggaagcactgggttaagtccccgttggaaggaatcttcatgactgctgacagttccaagtcttctcaccctccactcctgtgagttgctttccgactcctcccacatttagggagatatagaccagtgatattgtccatcccaggggtgacgtggtgcctaaaagtcaactctgacttcttcaccatcacgtgacacaaaagggttgattgcagagctttacaaccattctagtaccaaacgctgcccatcaggctagctaatgacaagatgataatgattagtaataatcgttgcatttattgatgacctactgtattagacagggttctcgagagggacagaactaataggatagatgtatacataaaagggagttgatggaggggtgactcataagatcacaaggtgaggtcccataataggccatctgcgagccgaagagcaaggaagccagtctgaatacccaaacctcaaaaatagggaagccgacagtacagccttcaatctgtggtcgaaggtccaagagtcctaaagctgaagaccttggggtctgatggtcaagggcaggaagcatccagcacaggagaaagatagaggccagaagactcaggcagtctagtcttttcccattcttctgcctgcttttattctggccatgctggcagctgattagacggtgcccacccagattgagggtgggtacgcctttcccagttcactgactcaaatgttaatcttttttggcaataccctcacagacacacccaggaacaatactttgactcctttgatccaatcaagttactaaccatcacacctactatgtgccaggcacgtagcatagagtgcttcatttaattcttctggtaaacgtgtcaataatactgtcctcaacttacagatgaggtagcagagactcagagaatgaagtcacttgtccaacaagtttacgcagctggaaagtagcgggtggtaagtggctggtttccttttcttcacctcatcgttcttagaaggctaacggtagggtgataaggaaggagagaagggaaaatagcagaggaagtgaggggaaggagggagggaggagaagtgcgctcagattaattagaaacagtgagagagggccaggtgcagtggctaatgcctgtaatcccggcactttgggaggccgaggagagtgaatcacataaagccaggagttcgagaccagcctggcccatgtggtgaaaccccatccctactaaaaaaaaaaaaaaaaaaaaaaaaacaaaaattagccgggcatggtggtgcattcctgtaatcccagccacttgggaggctaaggcacaagaatcacttgagcctgggaagcggaggttgcagtgagctgagatcatgccactgagttaggacttgtggttgcaagtgatggaaacctaacattccctaatgcaatcacaaagaggtattggctcattgaacatgtccatgggcaggtggacttcagtttcttcctgtcttttcttcatctttcagttctccttttctctgtgatgactatctcccgacaggctttttctcgtagtggcaaagatattccctatcagtatcagtcctatgctgtattagtccattctcatgcagctatgaagaaatacctgagactgggtaatttataaagaaagaaggtttaatggactcacagttccacgtggctggggaggcctcaggcaacttatgattatggtggaaggcacctcttcacaggatggcaggacagagcatgagtggaagaaggggaaatgccagacacttataaagccatcagatctcgtgagactcactcattatcacgagaacagcatgagggaaactgcccccatgattcctttacctccacttggtcctgtccttgacatgtggggattatggaactacaactgaagatgagatttgggtggggacacagagccaaaccatatcataagcgttgtcagcttagaaacctagagcagtaactccctaaactctcctaaaatccttcatattgacagtggttggccaggccctggtcatccatttctgaaggcaggaggtgatgatgccgtgagagagttggaggggcagttcccccaaggacaattgcagtactgttaccaaaaagggggaaagaatgcaggccagacaggaatccttaaactggacattctttgctttcccctccagatctactctccacctgtctcctccctcctctctgccccaagagtgatttctatggctaacatatgtctgtttgatatggtttggctgtgtccccacccaaatctcaccttgaattgcaataattccttcgtatgaagggcacggctaggtggaaataattgaatcatgggggtggtttcccctgtactgttctcatggtagtgaacaagtctcacaagatctgatggttttataaatgggagttcccctgcacaaggtctcttgtctgccgccatgtaagacatccctttgctcttcctttatcctctgccatgattgtgaggcctccccagccatgtggaattgggagtccattaaatcttttttttaaaataaattacccagtctcaggtatgtctttattagtagcatgagaacagactaatacactattatttccttagctttaaggtataatatacataccttacagtccatccgttacaagtttgcaattcaacaattttaagtaattttataacgtgctgcaaccatcaccacagtccagtttcagaacacttctatcaacccccaaaattcacttcagcctgcttgcagtagctcctggcaatgtgcagaatttgccttttctggacatttcataaacctggaatcacataccatacagtactctatatagtgtgtggcttctttcactcaacgtaatatttttgacgtttgtccctactggaacatgtgtcagtatttcattccttttcattgctgcattatattccattgtatggatggaccacactttgtttatccattcaccagctgatggacatttgggttgtttgcagtttggggctattatgagtaaaactgttatgaacatttgtttacaagtctttgtgtggacatgtgttttgaattctctcagcttcctaggagtggaattgctcgatcatatggtaagtttatgtttcaactcgtccattgctggtgaaaatgcaaaatggtacagtaggtttggaaaatagttttaagaacctgccaaactgttttccaaacctacggaaccattttacattttcaccaacaatggacaagagttctgattcctgcacatccttacctatatttagttatcatctgattttcaaaaattatagccacttactaggtacataataatatctcactgtggctttaatttgcatttccctaatgactaataacggtgaggttttttttttttttttttttttttttttttttttttttttttttttttcctgggacagaactttgctctatccccaggctggagtacaatggtgtgatctcggcacactgcaacttccgcctcccaggttcaagtgattctcctgcctcagcctcctgcgtagctgggattacaggtgcccacccccctgcctggctaatttttgtatttttttgtagagatggagttttgccatgttgggcaggctggtgctttttagtcatttgtatagattggatatcatatacacacacgaaaaagttaggcccttaactcacaccaaaaataaaaattatctcaaagtgaatcacagacctaaatgtaagagctacagttataaaacttctaggagaaactttagtgaaatgtttgttcaagtcttttgcttattttttatttgggttgtttgtcttattatcagttgcaagagttctttatatattctgggtacaagttcttcatcagatacatgactggtacatattttctcccagtctgtagcttgttctttcattttcttcaaggtgtcttttaaagcttttaatttgaaattaaaatgacatccactttataattggctcatacttttggtgtaatgtctaagaactctttgcttaacccaaagccatgaagattttctcttgttggtttctcctagaaattttttaattgtagctcttacatttaggtctgtgatacattttgagataatttttatttttggtgtgagttaagggcctaacattcttttgtgtgtgtgtgtttagtatatgatatccaactgttacaatgccatgtttgaaaagagtatcccaccccattccattgtcttgacatcattatcaattgttttgacatcattgtcaaaaatccgttggccatatacataagcgcttatttcttggctttcacttctgtaccattatcaatatatgcctatccttactccaatgccacacggtcttgattactgtagctttagagtaagctttgaaattgggtaggataagtcctccagctttgtttttctttccccaaattgtttcagcaattgtatgtcttttgcatttctgcattcattttagaaccagcttgtcactttcttcaaaaaatcctgctgggactttaacagggattacattgcatctatagatcaatttgatctatggattgacatcttaataatatttaatcttccaatccattaacatggaatatctctccatttatattttctctcatttctctaagcaatcctttataatgctcagtgtaccaatttttcatttttcttgttaaatttattccaaactgtttatttttgatgctattgtgaatgaactttaaaaaattcattctcaaattgttcatgactagtatagaaaattccattaatttctatatattgatcttgtatcctgcaaagttgctaaatttactagttgtaggaggatttttttttttggtggattccttaagattttctacatataggatgatgccatctgtgactaaaaaagttttacttctttctttccaatctggatgtctttattttatatatttttagctttattttactggctcgaatcttcagtaaattcccgaatggaagtggtgagaatgaatgtctttgcttcatttccaagctttgggaaaagcattcagtctttcaccattaagtataacgttagctgtgggttttctgtggtgcacttcatcaagttgaggaagttccctcttattcctagtttgtggatggtttttgtcatgaatgggtgttggattttgtcgattgctttttttgtgtctactaattcactatctgaacgtgccatctgtttcctgccaggaccctaaaaaataaaaaatgctcgctgcaaagtgaaaatttatgtgatgaaggtggattccctagtccctactcaatgaattattgcactgacttgatgcccattctctcagctttttagcttcaagagatttggttttaaaatatatccactaggccgggcactgtggctaacgcctgtaatcctagcactttgggaggccgaggtgggtggactgcctgagctcaagagttcgagaccagcctggacaacacagtgaaaccctgtctctactaaaatacaaaaaattatctgggcctggcagcgcatgcctgtaatcccagctactcgggtggctgacgcaggagaaccccttgaatccgggaggcggaagttgtagtgagccgatattgtgccactgcactccagcctgggcgtctccaaaaaaaacatatctatatatctatatatatctccactagtaatttgatactccttccttccaaaatggagcctaattctcctccttctgagtgtgaactagactcagtgaattgcttctagggaacagaatatggcagaaatgatggcgtatggtttctgagactaggtgataggaggcgttgtggtttctacctcatgattcactctgagagaaaccagccgccatgttgtgacatcactcaaggagctccatgggaagttccaccaagtgaagcctctgtgactgagtcactttggaagagaatcctcaagtcttctgactgtagccccagccaacatctgactgcaaacccatgatacaaatccagccagaaccacccagttaaactgctcctgaattcctgacccccgggaaccacaaggtaataaacgactattgttctaagccactgtgtgttggagtgatttgttatgcagcgtttgacaatacaaaagacattgccaccttctctcagaatttgttaagctctaaaaatgacaaagatgggtctgaaggaacaaggatttctggacctggaggctctttcagaagttagatcccatgaggatggggcattgctctaagaagaggttggtgagcattgtatgtgaaaacacttcgtaggtgataaatacggcataaacacattattgttactggaaggtttgttatagccttcaagcttacactcgatgtcatcttagccggcatccttctttctatcccaacacatcaggtctttgataatttgtgttcttctaagaaaggacccccagggtcctgccctcccaggaccgacatgctgaccaggcacttgatgtggacatgtcagaccacccacattctacttccttcagttgctttttctagaatgccagccaggagggacgggtacactctgaattttgatctcatgtgggtgggtgatctgctttctaattaaagttccctgcccggccccttctgcggaacgtttcacccaggagaaaagacctgaagcaattgtgtcaaagggtaggaaagcatttacacagcaagggagatcttgcttagcaattgggggagaaagagagagaaagatttgcctccagctgccattctgaactgtaccgtttgtacaaagtggaacgtaagtttctgttttctgaaaaggggacaagttgctattgataaagcaggaggtcacatccatctccatttgcatacaaattactttctcatctactttccaagggggagaaagagctgctttatcgttctcagagggagcaaactctccacgggttgccttgtatatttgtcagaactttttggatgcaagtgacagacactcaacccaaccctgagtagcttatgcaaaactggtaacttttttttttttttttttttttttgagagtttcgctcttgttgcccaggctggagtgcagtggagccatctcaattcactgcaacctccgcctcctgggttcaagcgattctcctgtctcagtttccagagtagctggtactacaggcgtgtaccaccatgcccagctaatttttgtatttttagtacagacggggtttcaccatgttggccaagatgttctcgatctcctgaccttgtgatccacccacctcagcctcccaaagtgctgggattacaggcgtgagccactgcacccggacactaaactggtcatttttgatctatctcatcaaatcacaaaagtagaaaagtctttcacttaataggggatgcaaatgccatcttccatcttatctcctcttttatctaatcaactgcctttattctctccccagaagctaaacccatggccacatggatatctccaaacttgaactcgagcctgctgtatccggctctgtacgtgctatggctatttggatatctggtagggctgtcaagctgagtgtgttgaagctgtttaggatcttgctcttgtaacctgctccccctcctccagtgttttcctgtcagagtagatggctccacttgccacctccttgggcagctgcataagccagaaacctgagcatcacctctgacccctccctccctcatccccacacagccaatgagtaaatacgactggggtccaggtgcctctttcttaccacaatttttatattttatcttaatttttatttttttgagacagggtctcactctgttgcccaggctggagtgcagtgctgtgatcccagctcactgcaacctccgcctctcaggctcaagcaattctcatgcctcagcctaccaagtagctgagattactggagcacaccaccacacccctgctaatttctgtatttttcgtagagacagggtctcaccatgttggccaggctggtcttgaactcctgacctcaagtgatccacccatctgagcctcccaaagtgctgggattatatgagccaacgcgcccagcccaggtggctatttctagtccccctgccactccctagtccaggccatcatccctgcagtgtggactagggtaaccatgttccaacgagttcctttcccatctattcctgcctccctctgatttgttctccataggattgccataaatgtccagaaaaatgcaaattagatcctggcaagcccctactgcatgctctcctctcaccattaggataaaactccaactcctcaccatgacgtgatcccagccctgcctgtcttacgccagtggccactttcctctctgccgtccgcacagcagcagctctgctcctgtccactccatgacctcgaagcatacggtttcccctgcccaaatgttctttcctcctgctttacctgcctagctccccttcacacttcagagctagaatcccctaggaaacttaggtgagaggatggcttgaaaccaggagttcatcagcctgggcaacacagtgagagccctgtccctacaaaaacaaacaaacaaacaaacaaacaaacaaaacaacaaattcactgggtgtggtgacacaggcctgtggtcccagctactctggaggctgaggcaggaggatcccttgagcctgagagttggaggctgctttgagttgtgatagcgccactgcattccagcctaggtgacagagcaagaccccatctctttaaaaaaaaaaaaaaaaaaatttcagtgttggccaggcttggtggctcatgcctgtaatctcagcactttgggaggctgaggtgggcagaccatttgagcccaggagtttgagaccagcctagacaacatggcaaaacctcatctctacaaaatatacagaaattagccaggtgtggtggaacatgcctgtagtcccagctacttgggaggctgatgtgggataatgacttgagtccaggaggtggaggttacagtgagccaatattgcaccatacactccagcctgggtgacagagccagaccttgtctcaaatctacagataggcaataaatttaaaattattacatgaacttgttgacattcctctctccaaaatggagcccaattcgcctcccattaaatggggatggacttagtaacttctaatagagtacttctaataaatagaagtggcaaggtgtgacttctgaagctaaattataaaaggcattgtgtgaattcctctttgtgttctctcttggatcaccggctctgggaagagccggccgccatgttgtgagaacactcaagcagccctctgaggaagcccccatggtgaggagctgtggcctcctaccaacagccatgcgagtgagtttggaagtggatcctctagtctcagttgagcctttggatgatgcagccctggccagcatcttgattgtatcctcatgagagtccccgagccagaaccactcagctaaatcacttgcaaattcctggcccaaagaaactgacataataaacgtgtatttttttaagccattaagttttctagcaatttgttatacagaattagacaatatagcaacttcttagatcattcttacagcctttatgacatttatattcaaataattaactgtggaatgcatggtttggaaatgtctgttgcagtccctgctgtaccctcagggtcctgacctggtaaatgcttatagaactgaacttcatgctgggagacagtggtatgccaggcaaaacagacacctgaagcccattgtttctaatatgcctctcctctatagacaaaatcattttctatcaccatgatgcaacagatactgtttgaatgcagtaaaatctctctcgtatacactaacatttgcacatatggaacaaaacatgacacttctctgttcttttgttttgctgttttaattgtaaaataaaaactccaagtggtcacaaggaaaggcagaattaaagtaattcaaattctctttgtcttcataatgactgtgctattgtttattttgaatctactaaacacagttgatatgtaatatgcaatgccacaggggatggggacctgaactccacaccaactgagccctagtgattcagaatcttggcagacttcctcttcacatgaacacgtgcttctgggtccctgagtgttggggtcgattacacaacagggacgtctccaaattaacctccgcatcgaagactattttagaggacaagtcattcaatgtgctaatccatagcgatattattaaaactcaacagtaactgtggcaattgtccagaaattagaccaacaaagagattgagggggaggcatatgttatccgtggcactgtgtagaatcacatgtggtgagaatgaaaagcagattgattttgagttggttttgttttaaaattctctacaggccacgcactcccgatcacaccctctccgacccccaaggtggacgggctcctactctttgtatgccacttctggaagagcagggaaagatggatccatttgtgagctatgagcaagacaccgtgctgggcacctgcttttttttgagatggagtctcgctctgtcacccaggccggagtgcagtggcgcgatcttggcttactgcaagctccgcctcccgggttcacgccattctcctgcctcagcctcctgaacagctgggaccacaggcatccaacaccatgcctggctaattttttatttttagtagagacggggtgggcacttgcttttaatggaacagggctagcatccgccatctagtgatttctgtggcatgcttgcagacatactcaaggacagtggtccaggcagcagttcctctgggataacactgggccccccagtgacagcccagggtggggtaggtccatcccccgatccagctgtagttctgcagctcctgctgctctgacggagcctgggtcccgaacggcagagccctcccggagcagagcaggggttgttaaagacactttggatcttgtgaggtgacagctccatttcccacgcacaggctttaaaatgcatttaaatatttcaaatagtctctcaattttttagaattcataaatctggaatactaacaagatcataaaaaagcccactcccaaccaataggaaacagaatcgatgtattcgtatgtttatcatttatttccatttcccacctggatagtccccggagatttgatttcttgtttcctagagaatctgaagacagaaaacagaacttggtgttaaataatctttaacgtacacctgttcaaactatcggcaagacactaatcatttgtcctgatgcacaaacatcaatccagggcacatgaaattttaactatcaataaatattccgacatctgcacacatgcagcatctaattccagcatcaaaatgcagataagcacgaatagatatttggatttatagcaaaacgagtctcatctggaaacccctcccaggaaggtctggcaggctgggtgtaaggaatttgggacgatgcctgcatttcctctgcccgtttctaccaagtcggtccagtaatcctgtttaattaataataaacattgcaggattttttccccccatttgaattatgtttgaaatgtgatggctggatgcttcttataaaaatgctttgaaaaataaaccgtgtcagaaatgagtgatttatcatcactcagaatgctggcaggggaaatctcagaaaaggagagaattgatgttgcttcctgccggcatttctactacagagctggtccaatttgctttcttcctgtgcccatgcatggggcagcttttgcatgaggcactcccctcacttgtttcgtgtcttttttttttttttttccctctctcccaggatctgcccaggcctttggaggccagacctccctgatggcacagtggcaggcatctgggtccttggggaactccccacgatgcacaccaggcaccagccaacgtcaaaggtcaggagaaaggagctcttgaggtctggatgacttcaaatgagctgcatcccactgaagcgttcagtctgccgagctttcaggccaaggttcctgatcagattctgttcaatcacaaggtacagctctgccgtccataatctgctctgttaggaatacagcaattattgagcacttactatggatcacgcctttttttttttttttttttttttttttgagagggagtctcgctctgtcacccaggctggagtacagtggcacgatctccgctcactacaacctctgcctcctggactcaggaaattctcctgcctcagtctcctgagtagctgggattacaggcgcccgccaccacacctggacaatttttgcatttttagtagagacagggtttcaccatgtcgcccaggctggtctcgaactcctcacttcaagtgatccacctgcctcggtctcccgaagtgctgggatttacaggcctgagccactgcacccagccctggataatgccctgttctaagacctttgtatgcacaattgcacttgatcttcaccaaagttggtattcattgcatccccattttgcagatgacataaccaagatacacacacaacaagcaagaggccaaagccaggaaagtaacccaaacagtccgattccagaacccagactcttaatcacttcactgtgttatttattattattaataatagaactaggtgtggtggctcctgcctgtaattgcggcactttgagaggccgacacaggacgatcacttgagttcaggagctcgagtccagcctgggcaatgtagtgaaatcccattgctacaaaaaataaaaaacttaaccaaggatcgcaggcctgtggtcccagcctcaggaggctgaggtgggaggatcacctgagcccaggaggttgaggctgcagtaagtcatgattgtgccactgcactacagcctgggcaacagaggaagggcccgtctcaaaaatagtctttctcagcactctataccaagtgatatgccgggccctgcgtagatactatgtctttactcttatatgattgagatcattgtccttgtttgactgttgaggaaactgaggttaccagagtgaagtgaattgtctaaagaaagtcttgaaccaacacaaggacccaggtcctcccagatccatagctcattttcaacgtacttacttagtgtcagtctgctcgactgacatgacagatgggtggtggggactgcggtcttggtggggagatctctggagatccaccctttggaacaacatagatgctccagtttcagatttctcacgtccagtgtctgttctgtttttttgtttttgttttttttcctttgctgaatttaagcagccccagcagagaaagccaacgaatggcgatgtgaaaaaagccgtgtggacccgttcctctccatcacccatcagatggtttccaatcaggaagcaaagctgggccagagtaaatgttggagtatgtggagcagagggagtgctcatgccctgctgatgtgaatgcagattgatccggccttggagcaactgggcagtacccagtgaagttgaacctgtgcgcccccatgacccagaaattccaagggtacatgtagaccaggagacatgcatggcagactcatggtttataaatgggaaacagtgggagacaacaccatgtccaccaatgggggaaggtggaccagacgtggtgcatccataagatagacttctacaggcaattgaaatggagagactagatgtgcattgataacacaggtaattataaaaaaattcaatgtcgagtgacacaaaacaagttctaggaacctcaaagcagcccaaactttattataatattatagattgttcatgggtacacctataagagggtagaggcacatccccgatttgagagagaggggagagggactgaccttgcaggtggggctgaaagggacttcacttgatctgtgatgttttgttcaatacatatattttttattttctatttattttattttgagatggagtcttgctctgttgccaggctacagtgcagtgatacaatctcggctcacagcaacctccacctcctgggttcaagcgattctcctgcctcagcctcccgagtagctggaactacaggcacatgccaccacgcccagctaattttttatttttagtagagatggggtttcaccatgttagccaggatagtcttgatctcttgacctcttgatccacctgccttggcctcccaaagtgttgggattacagatgtgagccaccgtgtctggcccactttatatttttataaatataaaaacatgaaatgctgggtgtggtggctcctgcctgtaatcccagcactttaggaggctgaggcaggaggatcacttgagccctggagtttaagaccagcctaagcaacaaagaagaccctatctctacaaaaacacaaacaaaaaaccaaaacaaaaaacaacaacaaaaaaacaaacaacaaaaaaacaaccaccaccaccaccaccaccaccacaaacaaaacttagccaggcatggtggcatgcacctgtggtcccagctacttgggaggattgcttgagcccatgagactcatgttgcagtgagctgtgatcgcatcactgcactccagcctgagtgacagagcaagactctatctcaaaaacaaaaacaaaaacccaaagacagaaaacgttggcatttgtcaattttgggtggtgagaacctgggaacatgttctgttattctctgcacttttctgtgttttgaacatttctaaaaataataataaaataaaataacccatgtgaaactacatactgaatttctatggtcctcttcttccgtgaatagtgaatgtgttttggagtgggtcgggtggcagaaggaggctgaagccagctccttaaacaagttaatttcctgccaacacgctttcctcagctgtagcacagagggaaagcagagagctggctgtgtttgcagcttcatctgggagaccttttaaaaaaaatctggacattgtaggcaatattgattaacatatacatagaggcatggggtggggggagcaaatcaatcaataaatgcatttcttctgttcctgaccttagataatgtgtgctgattaaggggcatgtcacttgtttttaaaaccagtgttaaatattaattacaaatcatatggcttgaccccaggaggggccactgtcccccctccctcggggctctcccagagctctgaaagcagcccaccctcctctgcctccgagaaaccaggcagatttacattaggaatcaccatgattattgttctttttatggtggctactgtggacaagacaattatggaaacagaattcattgttcgaacaggctgagctcatgatattactgtggatttaaaaaaaatcatttcttggccaggaattaaaaatagctcattctcccccccccacccctctctttctcttgccagatttagaatctgagggaaccttgatagtttccctcctagttaatattcctgaggcaacttgcatttgcaacacggttgagaatcattttattttaaacaccagttcttcccactattcctgtgagggagttccaagttattagctcagttttaaatacaaggagatgggagtggagaggcttggggcctctcccggggaccaggtcagagaagtctgcatgctcaaggagagcggaatctcagtcccttctcatcagctgccttttcatctgtcctcaatgtgttctctgccactttagcatgtaagatttcaatgaccaggcaggcacggtggctcacacctgtaatcccatcacgttgggaggccgaggcaggcagatcacaaggtcaggagttcgagaccagcctgaccaacatggtgaaacactgtctctactaaatatataaaaattagccagacatggaatacacctgtaatttcagctactctggaggctgaggcaggagaattgcttgaacctgggaggcagagattgcagtaagccgagatcgcgccaccgcacttcagcctgggtcacagagcgagactccatctcaaaaaaaaaaaaaaaaaaaaaaaaaaaaaaaaaaaaaaaaaaagatttcaatgacaattttttttttttaaaatgcacatggaaacagaaccccctggagtagccccagccaggagcagaactcaggagtcctgatgccctaaggttcttgctaatcttctcctctgcactgggttaaatgctgtcttctcccaaattcacatctacttggaacctcagagtaagatcttgtttggacaaaaggtttaattgcaggtgcaatgagataagacaaggtcatgctgctcacagcctcacattccagggccacctcttgcctgacaattcctacccctctcttggtttgatttcttcaaaagctgtttcctaaacctctgcttctcaaacattaacgagcacacgggtcacctgtgcatcttgttcctcagcattttttttttttttgagatggaatcttactctggcaccaaggctggagtgcagtagtgccatcttggctcactgcaaactctgcctcccaggttcaagtgattgtcctgtttcagcctcctaagtagctagaactacaagtgtgtgccaccacacctggctactttttgtattttttagtagagatggggtttcaccatgttagccaggctggtctcgaaccgctgacctcaagtgatctgcccacccgggcctcccaaagtgctgggattacaaatgtgagccaccgcacccggcacccttagcagtttctgatactacaggtctgggtggccttattctgcacctctcacaagctcccagtgacgccaggcagctggtctggggacactttgagtagcctgggtctcaccatcacctgtgactctagccctggcccatcagtgactttctggcctctgggctcacctccatctaatcgacaggttgctaacaccacctgatgtcctcagagcaaagtacctattgacggccggtgatgcagtaggcaagcacttcaggcttggggagtttaagctcttttattgccatggcttttatgtgctctctgcatttgagagctttgcaacttcattagtgtacagagtactgctgaaagaattccttggtcgcccctcagaccttttgataaacaaacattgtaaatgtaataatcaggtcaccaccattaaaaattattataattaaagatgatacaagctgcccgaacccttgatgaacccactgcctttgtttggagctgttgttaaatgaatacataggtatttttcttgcaaagcaatgttcttcctgcttagctggtttgagacggagtcttgctctgtccccagaatggagtgcagtggcgctatctcagctcactgcaacctccacctcccgggttccagcgattctcctgcctcagcctcctgagtagctgggactacaggtgtgtgaccacacccagctgattttttgtatttgagagagatggggttttgccatgttggccaagatggtccccatctcctgacctcgtgatccacccgtctcggtttgtagctgatcttcctatttgctttcttcctagaagatctttctacaagtctgttctattctgctgatgtcatttgttttgcatgtaacattgctaggagtccaggggaaatctttatgctcaagggctgggggacgacgttagaagctatgatacaactccgaaattataacaggaaataattattacaagagaagaaatatcacacttgtctacactaatgcacttgactatcaaacaaagagatctttaagatgatgaagcacgcaccacgcaggagaaaagtgaggaaaacgcggctacaatttgttctgagtcatatctcttatagaagggattgcattctgctttgtcatcatttactaagaaagttgtttgcaaatgagaggaaggattcaggctatggaaaccggctcgaggtcaggcggcgtggagttgccagggctgcggttctaagacaagtgtctcacccagttcgcacccatcgcgaaacagattcaaggcacaattcagacagaaggtgaaaaggagatcctcactctggcatgggctgaatatttaatacctccaaagtcaaaaataagaacggctataagaagacagacaattatagccctagcagagaaatttcactgggccctaatacaccccgtgggatagtttgcattgtattttagagctgggaaaacaagctaagaaaggatatcttcatgaggttgctcaactcataggggcagactttttttttttatttttattttttggagacagggtcctgctctgtcgcccaggctggaatgcagtggcacgatctcggctcactacaacctctgcctcctgggctcaaacaattctcctgcctcagcctccaaagtagctgagactacaggtgcacgtgaccacacctggctaatttttgctttttttttttttttttttttggtagagactgggtttggccatcttgcccaggctggtctcaaactcctgggcttaagtgatcctcccacctggcctcccaaagtgctgggattacaggtgtgagccactgcacccagtctcgagctttatctctcacatgtgcctctattcaggattccaccctagttttgaagaaatagattcacattctgagtagtaaagttaaaaacaaggatctcaataaattttatgtcacctacaattattgccaggttttccttaatgtcatgtgtaggctgcccaatactcgatgctcaaaacagattttagggagcagaaaaaagacagggagacagaaatggagacacagaggaagggagttgtttgatgaggttggcctatgttggtgagaatacagcacaggtgctttcaagcttccccttcactaaattcaggatgcttttctttgttttttgagatggagttttgctcttgtcgaccaggctggagtgcagtggcgtgatctcggctcactgcaacctccacctcccaggttcaagcaattcttctacctcagcctcccgagtacctggggattacaggtgcccgccaccacatccagctaatttttgtatttttaatagaaacgtggtttcactgtgttggccaggctggtctcgaactcctgacctcaggtaatctgcccacctcggcctcccaaagtgctgagattacaggtgtgagccaccatgcccggcttttttttttttttgaaatggagtctctctttgttgcccagactggagtgcagtggcacaaccttggctcactgcaacctctgccacccgggttcaagtgattctccttcctcagcctcccaagtggctgggattacagttccctgccaccatgcccagctgatttttgtattattactagagacaaggtttcactatgtcggccaggctggtcttgaactcctgatctcaggtgatccacccaccttgacctcccaaagtgctgggattccaggcgtgagccactgcacccggcctttttgttatttgttttgagacagggtctcactgtcacacaggctggagtgcagtggctcaatcatagctcactgcagccttaacctcctgggctcaagcaatcctcctgcctcaccctcctgagtagctggaactacaggcatgcaccaccatgcccagctaattttttgttgttgttattttgtagagatgtagacgtcttgctatgtttcctagtgtattagtctgttcttgcagtgctgtaaagaactacctgaaatcaggtaatttataaataaaagaggtttaattgactcaccgttccacagactatacaggaagcatggctagggaaggcctcaggaaactcacaatcacggtggaaggcaacggcgaagcagacacgtcttacatggacagaggagaaggaagagaaagaacggggagatgctacatacttttaatcaaccagatctcgtgagaactcactcaatatcatgagaacagcaagggagaattcctcccccatgatccaatcacctcccatcaggccccacctgcagcactggggctaacaattcaacacgagatttggctgggaacacagatgcaaaccatatcacccaggctggtgttgaacccctgggctcaagcaatcctcgtgccttggcctcccaaagtgttggaattacaggcgtgagcagctgcaccgggccaggatggcttcttctcacaaggagtgtctactcccaaacccagtgctgaccttgtggccctgctccatgaaatgctccaacacccacccaccttccaagccagcaccaggggagctgcctggcccattgctctcccaacacacatttcggccaccaagccctggctccaaacttgtcccttcactttatcccagatgcaacacctgcaaatggcagccgtccattgatcccgacaacaaaaacagtgaggcattgacttctcccaatctgcccccagccacagaccagattcagctgaaactggcatcagctgggtgggatcctcttgagtggctccttttgcctaacgggcaggttccagacagcctagcacgtttcatcagggttgccacgaccaggccctgtggatatcagcaggctttcctattctcactggccagtctctggaccggccctggtctcccagccacagcacttcctcctgcatcacctttgtgggtgcccttaacagacgtctgcacctttcccaccatgtacttgcaacctccctcctctgagaagccctccggtctctctctggcttgcagcaggggggctgtggctcctctaggcccccagagctcctgcagctgcccctcccctgttgcagtccgcacctcaccacgctccacttcctcctttccaaacctgttgttcccacggccctgtgagtgccaggaaagatgacacacatctcctgtctctctccccagccaagactctgccccacaaacaggcctgatgttttcacacacctgggagttactttaatctgcgatgctgagacatgcagacatgggcatccctgccaggaaaaaaggagtttacactcactgacccctgaaaaccggagcagcccccgcagggctgcaggcggaagcacctgggtgggtcatgagttagagagataggggactagtgcggctgtccccttattcagacagctctccaatcaggaaaccactgttattaaaagtccccttgcttatttcattttgctaagccttacttgcatgcatcgtgtatctttcacataacatttccccatttgcttatgtcacagggttcgctaactacaggcgagaaagaaaacattcccaatgagtgcagacacacgtgccctctattgtgttcattccgggttaaataattaggttattgggagtctctgtttttgtctttggtttttttttagagacagggtctcactctgtcacccaggctgcagtgcagtggcacaatcacagctcactgcagcctcgacctccctgatctcaagcaattctcccacctcagcctcccaagtagctgggactacaggtgtgcaccaccacactcagctaattattattattattattatttgtagagacagagtttctccatgttgcccagtcttctggtctcaaactcctgagctcaagcaatttgccggcctcggtattggtgttttaaatgctcaatgttacgcaaaaatgcttggtggattcccaccccccaccccaatacaatgaaacatggtatctcattcaaaagcgttgccctacttgtgactcctttcaaggagtgggttaggttgatttttcactcagcaatcagcaatagagtttcaattcattattttaaactgctacatagtattctataatatggatatacctaaatgcatccagctactctatagatgaaaatttactttgtttctattttcccccactccagacaatactataccatccttgggttgttgttttttcctccagtataaaccacgcagtaaaaatcattcattttccggccaggcttggtggcttacacctataatcccagcactttcggaggctgaggtgggaggatcacctgaggtcaggagttcaagaccagcctcactaacattaaaaatactctattaaaaatacaaaaattagccaggtgtagtggctcctgcctataatctcagctacttggaaggttgaggtaggagaatctcttgaatctaggaggcagaggttgcagtgagctgagatcttgccactgcactccagcctgggtgacagagcaagactctgtctcacacaaaaaaaaaaaaaaaaaaaaaaaaaaaaaaaaaatcattcgttttccttgtcccaaacagtgctgcaataaacatcctcctctatgtttttcatgtgtcgttggttttactagtgtaggacagattcccaaaagtgaggtttcttgctaaagagcatgcattttaaattttaatagacattgtatggttaatttgtgtaaagttgaaagcaattcacactcatgaacaaggaatttgagtacccagcttcgtgtattgttgaggcattggaagttactgttcattttctagactaagagatgaaaaatagtatcccataattaattttatttgcaccttgaatgtgaggttgagcaactgtttctaagcccgataggcaattttgatgcccccttctgtgaactgtctgtttatatcttcttgaactatttttctctaaagtctcggttttctcatccataaaatggggaaatgagagtacgtatctcgcgggagtcatgaagatttaatgaatcagtggccataaggagctttgcgaagcagcttgcaacagagaaaacattatcattttcattacacgctgggtgccagacacatggtggctatcaaatcttttatcttttttctccttccctccttcctttttattatcattattattattattattattattattattattattattattttggtgttctccatacagagggttgggcttgggaaagaaaaaggcccacttaagagaaagaccacatgttgggctggctggaggcaggagccagacaggaccacacagtggcaggggaaattgtcaggagctaaggctggggaactcaaagggggagtcactttgacatgagtggttttgggggttgagaaaaggggtctgggctggacatagtggctcatgcctgtaatcccagcactttgggaggccgaggcaggcaggtagcttgagcttaccagttcaagaccagcctggccaacatggcgaaaccccatctctactaaaaaataaaaaatacaaaaattagctgggtgtggtggcatgtgcctgtagtcccagctactcgggaggctgaggcaggagaattgcttgaatccgggaggtggaggctgcagtgagccaagatcgcgccactgcactctagcctgggtgatagagcgagactccatcgaaagaaagaaggataagaaagagagagagagagagagagagggaggaaggaaggaaagagggaaagagggaagggagggaaggaaggaaagtgggtctgatcttgagtcgtaaccatgggaatagtgaggatggaccacctcccatgttcccagcactttgcctggacaacatgccagtgatatgggaccgatcatttctctccatcttatggctcagaggggctaagcgatttgcccaaggttgcacagcacgtgaacggcaggtcagaaatgcgaacccaggattgtctgacccccagcccctgcatgctccactaccccatcttaagagattgcctggcttctaagcagccctgccctttggtggaggaacctctgaacacctgggtcaggccgtgaagcccaaccattggcatttctagattcctctgctagaattttaggaagaaagttggaagcccccagagtcattgtgcacccttctgcatttctatatcaagtaggagatgcatttgttaccacgctaattagggcagaaattaactgaaatgctgagttttagcagagagcgaatcggctgcaggtgtcagtaattagcgaaaaatgagtcatttgatgtttgtagacacacagccttctcaactttgattcaaaaataaacttcgtgggcacattgttctgaatcactcctgctaatgcatgtgtctatcttaatgctgtaattcagtataaatattttaaataaatcagtaatgttgcttttcagtggcagtacacacatgaaattttctgtacaaaaatggagtaagaataaaatatttttagtaagatcggtagaaacctgaaaaacagccatacagaaattactgtttccttgctcttggtttttttcctctctctttcttttggtttcttggaatataaataattcacctccaatatcctgtcctgagcagggactaagcaagtaaaataaacagcatactggtgaatacctgcagggtttggaaatggaattaaaaatcccccttaaactagacattctcctgttagttcactgcttgggaacagcctgagttctgaggtgggtggagtaaaaaggaaacttacacagaggtagatgtagctgtgtcttctaaagcaaaatctatttccttatcaaactagttaagttggccaattatgagatacgagagcatctgtgtgtggagcaggtgggaacagaagcttggaaattatttttcctcatgaacagcagttgtgtgcacatttgtgtgtgtatgtgtgtgatgtgtatgtttgtgtgtgtgcattttaaggcttaggatcagtgattgcattaaccatagcccaacaggagacgtccccaccatgaaaaattgaatgcaagtgtctcattgtctcctttttttttttagagacagggtctcactctgtttcccaggctggagtgcagtggtgcaatcaatcgtagctctctgcagcatcaacttcctgggctcaagtgattctcccacctcagcctcccaagtagctgggactataggggcacaccaccatgccctgctgactttttacattttttatagagatgaggtcttgcctgtgttgcccaggctggagtgcagtggtgcgatcgtggctcattgcagcctcaaactcctggcctcaagtgatcctcctgcctcagcctcctaaagggctgggattacagatatgagcccctgcatcctgcctggtgtctcactcttgagcaagagaggtgctggcccctcccaccccctggctcggttctagagcgtcctgctgctctgtctctgaagcacgcatctgcacacgagcaagtcttgggttgaccagggtggggtgtaggaggagactctcctatggcctgtgacaaggtgaggggactctggccccagccagcctgacagcttttgtggtcagaagttggctggtcagtgatgtaggaagagttgactcaacagattctcttccataccatggcatccttgaggttaactagttgaatggtttgaaacaaagtgaatgggttaaagttggtgaattcatgattcgtaaaaaaagaagaaaaaagctctcattggtcacctttggaggtcagcaggatatcccctcattattttgaaaactggtcagtaaaagggaaaaaatttaagcatttatcgacctttcttatggcaacgatacatcagcgtgaccaagtggttgataaggggaaggtccttgttatagaagtattctagctaattaaggaagaggaatgtagactttgaatatcagcattttacatctcataatgaactaatggatctaagcaatcaccattacaaaccgtgaacaacctctaaaaaagacacaaaccaagcactctgtgccccccagtggaaggacaggacactacaccatgaaatattcttgtcaaatccccaaaactgaatgtgatcaaccctagatccaactactgatctatagaaaatgaagaggacagaagaacctgtcaaatgacaccatggagatgtcatcatcaaaatccagactgtggcctgtaatcccagctctttgggaagccgaggtgggtggatcgcttgaggccaggagttggagaccagcctgggcaacatggcaaaattccgtctgtacaaaaaatataaaaattatccaggtgtgttggcatatgcctgcagtcccaactattctggaggctgaggtgggaggataacttgagcccaggaggttgaggctgcactgagccgtgattgtgctactgcactccagcctggggcacagggcaagaccctgtctcaataataataataataataataataataataataataataattcaagattgtgcaagctgtggctagctctataggacaaataatccaattttttcattaagtgaattgtaaggaaaagagggaaagggtaataggttaaagaaggcagagacccaacagcccatcgcaacatacggatctgatttagatccccaggcagatgttagaataatacaagaaaaaatatctatgagacaaattagggaactttgaacactgcacatttgattaaggaattattgtgaatatctttagctgtgatactggtatcgtatttatgtttttgagagatgcctactgaaatatttacatgttaagtgatactggtatcgtatttatgtttttgagagatgcctactgaaatatttacatgttaagtgacagaatgactgaaatctgcttcaaaagattccagggctcatctaaagtgggtagaggaacagatgaaatgagattggccctgaattgaaaattattagggctgcgcgtggtggctcatgcttgtaatcccagcagtttgggaggtcaagaccagaggatcacctgagcccaggagttccagaccagcctgggcaacacagtgagaccctgcctgtactaaaaataatttaaaaaaaattaaccaggtgtgacggctcgtgcctgtagtctcagctactggtggggctgaggcaagaagatcatttgactatggaagtctaggaggtcgaggctgcagtgagccctgatcataccactgcactccagccaggggaaaaagtgagaccctgtctcaaaaattaaaaaaataaagcactacatttcctttctagaaacacacacacaggcagatgtgttccatgaatcccaataactgggacaaggagaggcgggatgtctgcagtgtgggatgattctgggcctctgaatgacactgagcggtctgggtggaaatccgcagattttccatcttccagggcagaagtcggcatgctttctgtaaaggactggaccgtgaatattttaggtcttttgggccatatcatctcggtcacaactactcatgctggttgcacgacaggggccaaagacaatatatgaagaaatgggtgtgtccctgttccgacaaaactttatttacaaaaacaggcagcagaccgcatttgccctgaggtggcagtttgaccagccctgtcctgttgctggacagaagaactttctgtgatgacggaaatgttatttctgtgccatccagtataggagccattagtcacacgcagttactgagcactttggatggggctagtcggactgaggaactagtttttaatttttatttagcttaaattagtttaactttaaaaagtcacatggagttagttgctaccacgttagacagcacagttctagagagcccagcccagcaactaaaaaggaggagaggctgggtgcggtggctcacgcttgtaatctcagcactttgagaggctgaggcagcaggattgcttgaggacaggagttttagaccagcttgggcaacacagcgagacaccgactctataaaaaaaatttaaaaattggagaagtgtagtggtgtgagcctgtagtcccagctactcaggaagctgaggtgggaggactgattgagcccaggagttccagaggagcctgggcaacacagtgagaccctgtctctacaaaaagtacaaaaattagccatgcgtggtagcatgcacctgtagtcctagctactctggagggtgagatgggaggatcacttgagcctgagagacggaggttgcagtgagccaagtctgtgccactgcccagtgagcctgggcaacacagtgacaccctgtctcaaaaaaaacaaaaagaggaagaggagatgcagcccagggagaagaactgatttgtctaagacgtggctccaacctttgggttcatgcttctccctgcgccacggtatgaagttgcctgaactccagaaccactaagcaatgaggcaggtgacctgggctctgatcctcaggctgggacctggggaaagccattcacctttagtgttctgctgtgtctccatgtgtacgaggaccacaccccaacctcctcgtccattcacctgtgggggccaccagggggatcacaggagacaatgtaggcagaggccctttgaaaacttcaaagcgccccgggagtttccggatgttctgcattaatttatctaatccaaggtaggaaagtgaaacgtgggctatgaaagacaggagggaagtcgggtgattcatcgctcggctggaactctcgcgggttaaatctctgtttcagtgaatttcctggggagaattcagggccgtgttccagctaacaaattcatccctttgctttgactctgaaccatattctgggacggcatcaaagccagcctcccaagagtcgcttggggactgtctgggccccgagctctccgaccctcctgcctccactctgcagatgctcctgctcccatctccccagcacagaccccaccacagcctcctgcctggccccatctgccatccctgcggctgagcccgactgagagtgaagtccttcattaaatcagtgcctacctcgtcctgcggatggaggtcattctcagcctcattccccttgccagagaaggatgtggggggaggcaggcagggcaaaggcagggagacatcctctggtccagaattgattcctcttctgaaagaaagaaaagcaaagatgtccctaaaggggacattaaaactctcaacaagaccctcaggctgggagtcttcttcccaaggccagggtcaggcctgagaggtgttctcaaagacccggagtgaaatcctcttcctagacaaagatgattccaaggatgattccaagtgggaaggggagagaggggccttgcacgaggcaagtaactaggcctgtgggagcaagttcgtaccgtctaccctctgtcaaactctgtacttgaaacggttcatgttttttaaaaggatgggcgttttaaatccctccattccgctctgccccgtgatgtaatttagaaatcacgagagctctcaaaaaaaaaaaaaaaaaaaaaaaaaacaaaaaccagcgagatgtgctcacagaccttggtccgcaaatgtttttgccagatgctgagaacctaggcagaatccagagcagcttttatagaggatttgatgtttaactcatcatggagaggtccctgatctctccctggagaaaaaggaagtcgatggggtcgtttgtacggcgaaaactacagcatgatgttggagggatcagggagcctccttcaagggtttagggggctctgggtcagggcctttctggacggttcttcccttgggaataggaagccaggatcacagaggggaagggtccagcccagatttggagctggataccctagtgggtatcccttaaacaggagcaggtgagcctgtgttacaggacccgatctggaccccaagagagggttcttggatcttatgcaagaaagaattcagggcgagtccatagagtaaagagaaatcaagtttattaggaaaggaaaggaataaaagaagggctactccacagacacagcagccccaagggctgctggttgcccatttttgtggttatttcttgatgatatgctaaaggaggggtggattattcatgcctctcccttttagaccatatagggaacttcctgacgttgccatggcatttgtaaactgtcatgatgctggtgggagcgtagccgtgaggatgaccagaggtcactctggtgtccatcttggtttttgtggggttttgccagattcttcactgcaacctgttttatcagcaaggtgtttaggacctgtatctagtgctgacctcctatctcatcctgtgacttggaatgccttaaccatctgggaatgcacctagtaggtctcagcctcattttacccagctcctcttcaagatagagttgctctggttcaaatgcctctgacatctgggtggtagggttgtgctgcctggcttcttaacttcctggctcagaacccaaacctgttgcctctggctgcccagccaatgggactgtgacagctgggacaggagagccactgagcttataaacacctgtgagcaggtatccggtagccagcggggggagaagcggtggatagacacagggcttcccagcttaggcaggaaaggactggcttccccacccaccctgtccccatacccccctaccaccaccactttctggaactttccttaaacaactgctgggctgttgcaatttgctgcttcccttcttttcttgttaaaacattttatattttaaatttgtttgcagacaatttccggaaaaaaaaataatatgtgtgtgggccacattcgtcatcctgcaaattttattattttttattattagagattgcaacgtgtgcctcaccatgcctttttcttcttagtaaaactaagttgagtttaatttggctaattaaaagacacgtaactcagatatctgaggcatatagagttaccacattcacagagtgtgaataggttacctattacctaaatagagtagaaaataggttaccaggagctgggaggagggtgcgatggttaatactgagtgtcaacttgattggattgaaggatacaaagtatcaatcctgggtgtgtctgtgagggtgctgccaaaagagattaacatttgagtcagtgggctgggaaaggcagacccacccttaatctgcgtggtcaccatctaatcagctgccagcatggctagaataaaggcaggcagaaaaatgcgaaaagagagactggcctagcctcccagcctccatctttctcctgggctggatgcttcctacccgccaagttcttcagttttggaactcggactgactcttcttgctcctcagcctgcagacagcctattgtgggaccttgtaattgtgtgagttaacacttaataaactcccctttatatatatatatattccattagctctgtccctctagagaaccctgactaatacagagggggagatgagaagttgttgaatggggacagagtttcagtttggaaagatgaaaacattctggaggtggatggtggtgacggttgcccaacactgtgaatgcacttaatgccactcaaatgtgcacttagaaatggttacaatgggccaggcacagcggcttatgcctgtagtcccagctactcaggaggccgaggcaggaggattgctggaacccaggagttggaggctgcagtgagcatcactgcactccagcctgggtgacagagctggaccctgtcttttagaaaatgaaaataataataataacaaagaaattattaaaatggtaaattttatgttctgtatattttagcacaattaagagaagaaacataactaacaggcattttggtgccttattaagatgctgtgtgtttaagcttttgtgaggctagtgtgtgtgtgtgcgtgtgtgtgtgcccttgtgtgtttgttgttgctgtgttttattttccctggctgacttggtgagctcttcattgaaaaatcagtctttccatgcctattaatatattctttaagtctgagggagaaattatcttttttaacactgtattttttaaaaggaaatttttcatggctcatgagctggacagccaaaattcacacaggggctctttggaccactctcctttatttttttgaaatggagtcttgctctgttgcccaggctggagtacagtgccatgatctcagctcactgtaacctccacctgctgggttcaagcgattctcccgcctcagcctcctgagtagctgggattacaggcacctgccaccacatgcggctaatttttgtatttttagtagaggtgaggtttcaccatgtgggcttgaactcctgacctcaggtgatccaggtgcctcggcctcccaaagtgctgggattacaggtgtgtgccactgcacctggccactggaccactctccttgaaacagttttgctcaatcccttttctcctcctggcagcggccacaaaatggagtcaaaacgttctttgccgcctgccttgttgactcacacttgtaaacccagaactttgggaggtgagaggatggcttgaggccaggaatttgagaccagcctgggcaacatagtgagatcttgtctctataaaaaaattaaaagttttttaaaatccaaaaaaataaagactccagaatagagtgcctggaacataagtgtcctcagtaaatgttggctatgatggttaatcatagtctgtattattattgaaattatcactgtgactgggcatggtggctcacacctgtaatcccagcactttggtgaagctgaggcgggaggattgcttgagcccaggagtttgagaccagcctgggcaagattgggagaccccatctctcgaaaaaaaaacaacaaaaaaaacaagttaaatctaaaagaaaagaaaagacatgctggccaggtgcagtggctcacacctgtaatcccagcaatttgggaggccgaggcagacggatcacctgaggtcaggagttcgagaccagcctggccaacatggtgaaaccatgtctctgctaaaaatacaaaaattagctgggtgtggtggcaggcgcctgtaatccctgctgcttgggaggcggaggcaggagaattgcttgaacccaggagccggaggttgcagtgagcagagattgcaccattgtactccagcctgggtgacacaatgagactctaactcaaaaaaaaaaagaaaagaaaaaagaaaagaaaagaaattccgtgtggtcacatcagacctagtgatgatttcttttcttctccacccacccacccaaccagttgtatttcccatggagcccagtagagggtagagggtagcagcttgagcacatcctgcatgggtgggaggatgatgcaggattaaggagcttctcttttttttgtcttgtgttctcaacacacttgctttctctcctggagggtatcctctcttacccacgctgtggagtacatgcctcactttaccctgtaagtagcccagctcaaaaggcagccatttctttcccatgagcaaggggcctcccctttcgggaattttcctttagattgggcagacctggacattcctccccttctgccctccttaggagggagtgctgtttagcttgggtacatgaaccccagtgatatggtttggctgtgtccccacccaaatctcatcttgaaatcccacgcgttatgggagggtcccagtgggaggtaattgaatcatgggggcgggtccttcccatgctgttctcatgatagtgaataagtctcataagatctgatggttttataagggggagtttgcctgcagaagccctctctttgcctgctgccatccatgtaagatgtgacttgctcctccttgccttccaccatgtttgtgaggcctccagccacgtggaactgtgagtccattaaacctctttcctgtataaattacccagtctcatgcatgtctttaatagcagtgtgacaatggaacagcacacccagagaagctcttctcaagtcatgagcagcatgcacatcagctgaaagtcccaagggcatatgcggattctgactctggaggtgcaggttttaaactaagttccagggaatgcttgctggtgcatggacaaccactcctccagctgcaagtctaagaccttcagagtatcactggccaagaccccacagaacctcgtgtgtggggaagacacaagagtgggttctgaccccagacgctacccaccgggtctgatggggaacattggcaggcttgtcacagctcccagtcagcggagaaacccctctggctacgagagccatatgctctagttttatggtgagagaggagccggtaaccagggatgatggagtggactggctcagaagcatgcaggaccaattacgggcactcctcagatcccatgcaacgtgaactgcctagggcatcagtaaggccccagggagcactccgggcaatagaaagttcaggacacctcacaaaggcctgtctgctttctgttctttgaaatgttcccttctaacaaggaaacagaagtgacttttgccttctctctctgctcagcccaagtctaaccagaactttttctttctttctttcttttttgagatagggtcttgctctgtcgcccaggctggagtacagtggcataagcacagctcactgcagcctctacctcccaggttcgagtgattctcctgcctcagcctcccaagtagctgggactacagatgtgtgctacctcacctggccaacttttgtattttatttatttatttttttggtagagataggggtctcactatgttgcccaggctggtcttgaactcctgggctcaagtgattctcctgcctcggactcccaaagtgctgggattacaggtgtgagcctgtaaccctgagttggggctgtggcgagctatgattggcctaatcaggacttccttgggttcacatacgccttgctcctgggaggagtgagatgaattcttatctgctgtgggatagaggaggggcaccagagcctgtgtttttacaccaaggactgcgtggggccctacagacctgcctttccctgcccaacctccttctctgaccaagacaaaactgcaggttcactgtggcaggtgattacaacggacagagggtttgttcccatactccatctaccagtggtgacacttcctttcccttcagctcacctgctcccccaactctttgaagaaatctcagtaattcactgagatcagagtctatcacacaaacatccgaaattgtagcacaccggggagcctgccaggaaggcctataatcagataacacattccagcccggagacctttccagaggaagggttaagctcccaaggtagttagtggaaatcaaagaactgcatgctctcattatctcataacaaacataccaggttaatagctgtcgctgccgctctaaaccacgtgtgttgtgttttgtgagtgctgacatggggcgttctttctcccaccatatctgcaacttgacagtgtcatcgtggttgggtgctggagtctcctaaagtgttttgcatactgtctcctgcacgttgcctcgaaggatttttaaataattgctgtgtttaatgggaactccttcccctctctaatcccctccagtagaaaagctggccagtgtgccagtgtgcccggggggcatttatttatagcaggaacgaaagtggagcgtcccaaaagactgtctgcttgtcctgagctggcaaggagcaaggttggatgcccagctgtcctggaccaccccttcccatggctcctccagcctcctctctcctgcttgcaccctggagcttccttccaagcaggatgggggtgggggtgacagagacagccccagaaggcagggactgactgtgggggacccacaaggcttgtcaggcccctcccttcccatcaacccctgagtgatgccagggcccctgggcaggtgctgccagggcttaggacacaaggacctgtgtcctgtgtgaattttgtgaattctgtgtgaattttgtgaattctgtgtgaattttggctgtccatctcaggaccactttgttcttggataggacaacgtggttgtgaggacaggtgtgagcaaggcagccagtagacctggaggcaggggctaggcagccccctcgacagaaccccatgaaattcttgcacgtggagatttatttgcacttgccctgaaatcccacaaaacagcgatgacaaagatggtagcacctctgtccatgagagaaggctggagcgtcaggctcctgggtgtcaaccaggtctggccagtgcctgtcatgcttggtctgggtggctctgggcctgcctgatgtcctcctgctgactggtcttggctggctccaggactgggaccctcctgggggtggcagaagcccctgagcctgaggcctagagggcacacctctgacagcaaggcagcaggagcctgtgctgaggtcagacctgggtgggaaatgcagctcccatttttaccagctgtgtgaccttgaactaccttccaaatctctccttgctcttcttatgggtggcattgctttgcccaacaagataagttggagtcttaactctaagaccttactcggagatagggtctttacagaggtaattcagatgaggtcatttggccaggcgtggtgcctcgtgcctagaatcccagcactctgggaagccgaggagggaggatcgactgagcccaggagtttgagatcagccttagcaacatagcgagacctcatctctacacaattttttaaaaaaattacctgggcacggtggcacacatggcacgcacctacagttccacttacttgggaggctgaggcaggaggtttgcttgaacccaggagtttgggctgtagtgagctgtgatcatgccactgcactccagcctggctcacagagcgagaacctgtctcaaaacaacagcaacaacaaaaagatgaggtcatcaggacggatggacattaatccaacataaccgtactctcacgcaaaggagaaatttggacagagacgggcaggcttagggaagaagagggcgtggagacacaggaagagcgccacgtggagatcacagtgatgtggctgcaaactaaggaaggtctgcggctcccagcagctggaacaagcaagggagagtctttccccgcaggcttcagagggagcatggcacttgactttggacttctggcctgcagaaccatgagaaaataagcatctgggttttttttttttttttttttttgagacagagtctttgctctgtcacccaggctgcagtgcagtggcatgatctctgctcactgcaatctccgcctcccgagttcaagcgattctcctgcctcagcctcctgagtaacagggattacaggcacctgccaccatgcccagctaatttttgtatttttttgtttctttgtggtttttttttttgttgttgttgtttcttgagacagagtcttgctctgtcacccaggctggagtgcagtggcgcaatctcactgcaacctccgtctcctgggttcaagcaattctcctgcctcagcctcccgagtagctgggattacaaatgcacgccaccatgcctggctaacttttgtatttttagtagagacagtgtttcaccctgttgtccaggctggtctcaaaatcctgacctcaagtgatccacctgccttggcctcccaaagtgctgggattacgggtgtgagccactgcagccggctagtgtctgttcttctaagccaccacgtttatagtacatggtgatgggatccctaggaaatgaatacagacacaggtgggtagtgctaaggagatgataatacaaaccccagggtggttgtggaatgatgtgagatcacaggacgcacttagcatgctgctgggcactagagacaggctctggaactgacagcgtctattccccagggaccaggggcccttttcgcaacctgctgaatattagcttgaccttggagctgcactacttccattttatttcatgatattttattttgctgactgggagtgagagaagggcagggaactcagagaccctgcaagtaaatgtatgtaaaatttgaaacgcaatttagcatgtggagccgagagccccgaaacgcgaaaagcactccgccccacacccatccccatccccatccccacacacaggggttgccattctgggtaggaacctggctgtggctgccagccaaagctcatgagagaggcgcggaacaggaccaggtaggtggctctgatcacaggcagcaaagcagttacagattcctttgcaaataagccaccctgtcgtcttttgctgtctcctttctggtatctcttccctccccgacctcatccacctccccttcctaacagatccaacttgcaaagattcctggcttctatgcgcctcttgcagcaatactaattaaatgtttcaaatgcttcttatccatggttaagtgaagataaaattttaatgatttaattagcaagctctaggaaaaaaaattcataatgaagaaaggcgtttgcaactgtcctaggctttacacatttctgcgtaatgctgcactggagttggaggaggctgggcctgcagtgtgctttgccacactgcctggaaacagagacacccccaacttgctccccagagagggagggtgtctctagccagactggctctcatcttttgagggggaaatggcaccctggaaacgagggacccattaactcagaaatgaagtggaaatgcttgaaaacggatgctgttttccaaagtagactctcgaaattggtccatttttcacacgtcctcatgactttttttcattttccttttagtgtgtggctctcttcgtttcaacatgggtaactgatttacttccagccacgtgaatgttcagagtttactaagagaaaactctcatggcttcagggaggatgggatttaaatggaaaaattaattgccttgtttgaagacttttggtgtttggagcctcgggaggctcccaccattcaaagtggttttttgtttgtttgtttgtttgtttttgtttttaatgcaaagtggttgacattgagtgaccccatgtggaacgatccttctccgagaggcgctagccttccctgagcaccttgacttccaccatcgggatcctctatgcaccctgttctgttcactgccaagtggcctcctgtgcagatccacaagttccctaaatggccttggaagacgcagggtgtgccatgttggttcagcagaaaatatcatgtcccgagaagccagtggacggcatcaccctggccaagctctggcacagggagctgcaatgtgtgtgccaagctgcttggagaactggctctggaagcagagcccctggtgcccagactggaatgcgggaccagaaacacgtacttttcgtcctctggggcgcggatgacgctggcacgcactggggctcctgctccacctgccctgaggtgagaccccatgtccatgtgccacacaccatgcaggcagcaacgagtgtttaccctatttcccctgcatgtgggacaggactttctaaacaggttgctaataagtagttgaataaatgtgcagcagatgccatcagtgctcgcccctcgagctacctctttgtcccctctgtcctgactatttgtactcaccacgactttcctttgctgtgttctgacgctttgatgtcttgggtcttgctgaccctggagggactgcgcctcccagggctagcggatccccagagatagtaaatgactcacttgtgagtatagctttcatctgcaaaccaaccaacccatctctgaccacttcctctgtagggctcttacactctggtcacccatccaacctgccctgaccaccccagggccaggtactggataacaaggggcagctcctgtgccccggagcccgctgaaatgatccaaacagccaacctgaagcctgctcgccctgcctcacctgtgctttccctcggaaaccaccacaaaggctctcacacgcttcctcccgcccctctgtctccggactgaccccggggctgctttgtgtggccccgtgtgacacgtcctggaatctgtgagtataaaaagccttttatcatgaccatcatttctgtgtctgtgtgtcttaccatacctgaattaagacaaatcctaagaagccttaaaacaccggccaggcatggtggctcacacctgtagtcccagtgctttgggaggccaaggtggggcggactgcttgaggccaggagttcaagaccagcctaggcaacatagtgagaccctgtttctataaaacgtttaaaaattagctgggcatggtggcacgctcctgttctaggtactcaggaggctgaggtgggaggattgcctgagcccaggaggtggaagctgcagtgagccgagattgcacaccactgcactccagcctgggtgacagagtaagaccttttgtcaaaacaaaacaacaaaaaaccatcatcgtagtgcactgccctgacttccagctgcctgggggccctctctggcccctagggtccaaaagagcctgagaatggatggccttctgcattcagtaacactgagccaatgactgacatatataaatatatgtatgtgcaatataactgatatatacatatatatatatataatataaatataacatgtatcaaaatacaatgtaaggctgggcaagcaataatcccagcactttgggaggccaaggtgggtggattacctgaggtcaggattacctgagggtggattatctgaggtggattacctgagtttgagatcagcttggccaacatggtgaaaccttgtctctactaaaaatacaaaaataagctaggcatggtgtcaggcgccgtaatcccagctactctggaagctgaggcaggagaatcgcttgaacatgggaggtggaggtggcagtgagctgagattgcgccactgcactccagcctgggcgacagagcaagactctgtctcacaataaaacaaaacaaaaaaataccaatataaatataactatacatatccacatattccacacaccacgccagagttggaatcactctgaggacatggtctacactgagtcactaattccgaacccagcaggatgaagcccaggtgccatggtggcggtcggctcggtaacacactctctattagaggctcctcccctcccgcctcacttctctactctcctatctatgcttccctgggccacctcccaaataaaccacctgcattggcatcaacatcgcaggatctgctcctgggaaatttcaaaatcaggcagaatgaaagaatgagaatacatcattcccagacacgtatctcctcatcccccatggaaggaagcgtgccacctgcctggccggagcagcccagaggctctccagcgtcctcttgtatcatgtattttggttcccaaatctgaaattcggtcaatcagattctctctttctttggaattcaaacaaagaaacaaggacttgatttgacacttggtggtgagaccaaaaccatggagagaggctgagtcatgtccgtggtggtgctgttaccaagaccccttctcagatcagactgtgtggaggccggccctgagagctgtgttgggtgtgcttaagagctacagatatccaaccctgtgatccatctgctccttttgactctcagcccacgaggctgatctgcacggacagtatcaatggcctaccctggttttggcttcccactgggctcacccaatggggatgcccagaagcaattcagagggacagaaggagcaaggccagggtgttgatgtccagctctttcctcatggggtcgccttgggcctaccaaccatgggccccaccaaccatgggccccaccaaccacgggctccaccaaccacgggctccaccaaccacgggctcaccaaccatggggcctgccaaccctagatcaaaaatatttaaaagaagaaaatacaacaataaaaataatacaaattgctaaaacaatgcagtaaaacaactatttacaaagcattcacattgtatccggtattataagtaacctagagatgctttaaagtatacaggaagatgtttgtgggttacaagtatataatatgccctttcatatcaggaatttgagcatctgcagattttggtatctgtgggggatgctgaaaccaatctgccatgggtaccgagaaaggactctaatctctttcttcagcccttcttggactatcttaatccaaatttaccatctttcctgatagatcctggtggggaccttttgcttgggcaagcctgtgtgggtctctgtttcttgcaatcaaaggcatggctttggggctcaacagatgagtgtcatccccagagagcccacattccaagacagcatgagaacgggggatcctctccagggggtcttggctcttttatgtctgctttaactcctcaaagaaccccattccttttttccagagaggaggactcaaggataagatatttctgccaaaaaccctttttctgtcattaatatgttaacaaatgctgtcaagtaacagtcgcggtcgaccgaatttgctgttggcagaggctgcgcgctgccacacaaggctgtgtctattccacacaagcccggctccctccaccaggagatcttggcattggaggtcaccagggcccacagtgggacctacctaccctgtcaacagtgacaatgtctcatgtatgaataatgccttcacggagcatttctaaattccttccttcaagggtggcagcagagattacaggagcagcgcagtgggaggtaggcactagcccatgcccggaggcagggagaagtggggagaggagggagcaagagtggatatgaacgccaagcacaggggagaggggatgagggcaggacaagccagatccagatgcaagagataacgtgtactgaagaaaaattcaaaggagatgaaaacgtcatacaaaggaaataggtattgaaaaatcaatggtggtgctcaagggtcttaagaatcaatattagaatcacatgcagagaaacaatgggtggaggtgttgtgggaggtgcagatgagccagacatgtcgaccagggaagactgaaccatccacaggaatagggtgtattggttagccacctctataaaactgctgcgtaacaaacgaccccaaaactcagtggcttaaaacaatagttatataggccgggtgtggtggctcacgcctgtaatcccagcactttgggaggccgaggcgggcggatcacgaggtcaggagatcaagaccatcctggctaacatggtgaaaccctgtcactactaaaaatacaaagaattagccgggcatggttgtgggcacctgtagtcccagctactctggatggaggctgaggcaggagaatggtgtgaacccgggagacagagcttgcagtgagctgagatcgcaccactgcactgcagcctgggtgacagagcgagactctgtctcaaaaaaaaaaaaaaaaacaccagtagttatttactctcattggtcagagggccagcagaggcttggatgtgcgaacctgggcttggccagagaggctctgatccacgcatctcttgtcttcctcctgagaccgtgggctggccaggcatgctctgctcatgatgatggcagaaggatcagagaacaagtacaaaggcgtgggtgctcttgaagcctaggtgcaccatcacacccacttcattccactgggcaaagtaagtcccatgggtaaacacaaagccagggtatggagaaacagatcccattcctttcatggaagaactgcaaagtcaacagcaaagggcatggatacggggagggcagagatgcagtctgtaacggtgggccaaggggagagaggcaggcaggaagatgacagctgggggctcatttgcaagcgtggatttgcctggttagctctggttctctgctcccttctttctggctctttctttttctggttactgggctataaattcgcagagcaggacttgatgacatcctccttatggccagtcttggcaccccaatgggcagctgttcaggcagtccacagatatttactgtggaccttcttggtgctaggttctgtggaacaggaggacaattcctcattcctttattggttcaattatttagtattccctaagtgtgtggatgaccaaaggaaggaaagatggggtcctaagttttaaattcttttaaacactctcagggccgggatcggtggctcttgcctataatcccggccctttgggaggccaaggcaggtgaatgacttgagttcaggagttggtgatcagcctggccaagatggtgaagccccatctccactaaaactacaaaaattagccgggggtggtggtgcgagcctgtaatcccagatacttgggaggctgggcaggagaatcgcttgaaccttggagacggaggttgcagtgagtggagatcgcgtcactgcactccagctttggtgaaagaacgagactctgtctcaaaaacaaaacaaaacaaaacaaaacaaaagaacccccaaactctcagtatctgaaacgcctctaatttatttatttacttatctctttctttttttcataccctgtgacatagaaggcaacggcctctaatttctaaaaacaaaaacaaatacaacccaaaaacttggtgtttgtggaaattgggaggtggggaaatcaatctactttcaaatttaaaccttcagacttttccaggggaggttaatatggcttcctcgatttaccaattgctctgagaccttccatctaaaatatcctgtccccctactgtgcatattcccagaaaacatagttccagtttttgtgctttctctacgatatctctctgacttgcatttgtattctgagacccagaatagctcaagtcagataaggctcaaaccctggacttcacaagcccagagccaggaggtcacggtataaaaacgctctctgcccaggtccacgctgggtacaacacatttgcaccaggacccggctgcagccccccaacccggctgcagccccccaaatgcaatccaagtaactccccattccccacaggggtccaatcagtgtagaatcacgttatcagaaaccatccattacatgacagtgaaaaataatgccaacgttggattattttatcttaaaatattaaaggagaaaaaattgtaactaataagaggactttaaaaaaaaatcaataacaaaaaccttcatttttgcttccctgtgtgaaaagaagtctcctattttcctacctgtccgctcaccttcctttcccagacttgcctgggctctcagccatcaggagttcttccgcccatcagcaatggtggctgcttccccaccttccctctggcctgctgggtagctctaggaaggctggaggactcactcgatgctccctgctcctctcctccctcatccccgagagtcctcctgggaagggttgttctcccatcactctgacccactccaccctccccaccctgcccccttgaaatcctccagggaaacttctggctaataaaattcctcgccttggtacattgatcaagggctggttgggagccctgagtgtgtttggtgttttggattcaccgtaaacaccccgcagtaaattcagctccgggatttgtatctgagtgttgcaaggagcaggtaatgtattccagggatgacaccctgttttctgagcatcattcggaaacattttcacatggcttccaatctgtccacctctcgctttgcagccccatgtggctccctggcgggaaattgactgggagaagcgagtcaataaatcagggatggtgcacaacatttgtgtttactccacttaaaccgatatttactggggagtccacctcccggggcccctgcctcctctcacacaagggtgggtctttaaatgtcactcacatggggcgaaacacttaggatcctcatcatgagaaaggataattggacggagcagatggggaaatttcccaaagcaaacctcctcagtccattacatattttatcgatcggacccaggggttctctgcctctctgccagaaccctgggaggggctcctttttcctgcttttagacttccccaagtcacggtcatcatctttctggattagcaagcaggctgacagccctgttcctcattttcctcctcccgaaggctgaggacacaggcctcattacaggagctactggcccacagaaaaattctttgcccccactgatagaaaataaaaagggggctttagaggctgcccagataattggaggcatccactgtgtccctgggggtcactggtcgcctctgcaccattcatcttgctgacagaccccagctagggtgtctatgtaggctgagcccacacgcccagggaattgtacaatttcagatctgttcgcttgcaggctctgctgcagggaagagggaaggctggggctacagaaatggggctagagagattgtgctgcctcttgtgaggtagagttcaggttctcagggcttctcttggacgagagggtccttccccaagtgcaggggaaatgtatcccaaagcccggccacacaacacaggggctgacacagagaccccaagctagaccttgacctccgccgcccctgagaaagctcgcccaaatgcaaagacaaacaaaaggaattgatcattggcttttgaacttcttaaggtcctttccaagcatcatattgactgtacgtgatttttactgtgcagaactttagtttttagaatctgaactccagtgaaattttggctgggtgtggtggttcacacctataatcctagcactttggaaggccgaagcaggaggattgcttgagcccaggagttggagaacagcctgagtaacatagcgaaatgcgatctctacaaaaaagcaaaaacaaaagcaaaacccacacacagataaattagccaggtgtggaggcacatgcttgtaattccagctacctgggtggctgaaatgagaggaatgctgaagcccaggagtttgaggctgcagtgagctatgattgcaccactgcactccagcctgggtgacagagcaagaccctgtctcaaaaaaaaaaaaaaaaaaaatagagacagaaaagtgtgactttactgtactgattattagttagcagcaaagtcgcctcaagcagtgccctggtttgggaaatgtgggagaatagcttatgatatccccaacctatcccctactccctaatcccccacccccaccagcgagtgtgctttggaggcctctgatcagggctgacaaactccaggtgtcagcaacaggggatgaggcaggtggggggtctggtgggagctgccaacttactgggatttccaccatcagcctgacaactctgctatgcaaaagccttcaaaacgttcgataacacctgtgtcgtgggttaaatggtgtcccctcaaaggggaagttgaagtcctaacctccagtacgtgtgcatgtgattttatttggaaacagggtcttgcagatgtcatcgggataagatgagttcacaccacaatgaggcaggccctaaatccaatgactggtgttcttatgagaagaagaaaatttggacacagggagaattccaggtagagaaggaggcagagattggagtgatgtgtgtacaagccaaggaactcacgtgacagcaattactggaagccaggagagagccatgaaacagctcctccctcagagcttgcaggaggaaccgaccctgccagcaccttgattttgggcttctggcctccagaactatgacagaagaagtttctgttaagccacagcccctggtaaattgtttcagcagccccagaaactgatacaaccttcctctgaggaattccggcccccaagcattgggggcaaatagactcagagaatatttggaaggtgatctgggggtacctgtccagatgtcatgttctcctaccttctgaccctgtggttcctctaccaggaatttatcctacagatggattcacagagatactcagaagcatttcacagcatcatctttccagcagtgtagaaattagcaaaacgaccccaagtccataggaatgtgcctaaataacgataatatgttcactctgtggaatattatgcagtcatgaaaaagaataagaaagttatttctgtgccaatatggaacaatatccaagacatattgttaagtaataaaaaaaaaaccccacataaaacaaaaaacaaggtaccagagaacagtatgttaaccattattttgaaactaaaataattatacacaatagatttgtgttgtttctagtagctatgttctataaagtcactaggaacactgaattagcaaatcctgaaccattgctctttggggaaatacaggattatgttctttcaagcctctggtcacatttttatcaacccaacaatacctagccccgctttatgtgtgtttctctttaatgacaccttatttcatagatattgttggttcattcacactgaactcatggccagcaacactataactcacgcctgcacaaagcttctctaacaaaaataatttctccgtgggacacatcacagccttctgtgcgtaggaccctagacagcacttcagtgctatgttcgaggggcatttacacagcaaaatcgctgacagaaagcatgaaaataagaaaaatgtggcattaaacagtcctcgaaaaggacattgaacaagaaggcagggtgtcaccttgctcagcctcagatgggactgtgtatggaggaagactcaaatctttcgtttctttgtgcatgtttgcaattgacctggaaaaccctaagagcattaatttcggggttacaaataagtgttagcgagtaggtgaattcccaagtacaaaatccacaaatatgaaagacagactgtatgtgcccatgtgtataagcaggacatgaaggcatagctacaggtatagatagctcttctgaaaggacacacacattggtaacagtctctgtttccttgggcagaaggaaaagggaacgggagaaggagggtgacttacctcttactctattgccccttttgtactgcttgaaatttttactctgtgaaagcaatacctaactttttaaaacctaaatgttttaggctgggcgaggtggctcatgcctgcaataccagcactttggccaaggcaggaggatcacctgaggccaggagttcaagaccggcctggacaccatggtaaaaccgtctctactaaaaatacaaaaattagctgagtgtggtggcgggtgcctgtaattccagctactcaggaggctgaggcaggagaatcgcttgaagccgggaagtggaagttgcagtgagccaagatcgtgccattgcgctccagcctgggtggtaagagtgaaacttcatctcaaaacaaaacaaaacaaacaaaacctaaattttttaaaaaagttcttgcattttacagttggtcatattctcactttatgagctgattttcagcttgcacagtttgaagatgactctggtgattgttaaatgaaaaagaaaaaaactgatttcttgcaagtcgctagctgcagggggtggggagttccgggtggatcggggggacattccttggtgagaatagtactcaagtcatccgtctcgtgacactgtccctgttcagcctgataacttgtagctccacacacgttccagatggtgtcttgtgttgggtgaccctgggtgctgtctcatctggaattgttagctgtctcctgctggctgcaggcctgtggaccatacccttccccagcttgcactaggggatcctggatgagaagtgttgacttcatccccgggacctaagagcctaaaagcatctttactttcaaagtcttgcatttccgtcatcttatctcatgctcaacacaagtgagggagggagagaggactgccgtgactgtccccatttgacagggaaaccgaggcagtggggtttggacaggctattggtgtcagtgtgaggtcttccacccgggtctcctggctatgacttcgtactgtctctacagggtcctaaatggcactggcaaaccagagattaaggcaagaactcattgagttggaattctttttaaggttgtcttaagctttcctctgctgcagaatatcatccggcaagcagcagagtgggccttgtaaaatgtaaattggatcgtgcactgctctgctctgaacccctccacggttcctgtctcacccagagtcaaggccaaagtccttgccgcgtgctttagtgtccccatagcctgtccctgctatgtggtctgacctcgtctgtcctctcttaactttactgccccatcactccccagaaacctggtcttcttgctgctccttaacaggcctcagtctgcactttcagttcctggtcactggagctccgtccccagatccctgcatggctgcgtggctgtgggctgcagtctgcatggctgcagggctgcggggctctctctccaaatgtcacctctctgtgaaggcttcttccaagtcttcgccgggttgtcattataaggtcattctctttacaatgtttcagtgaactgagcaattgttttctgtgtgttctgcatgttaatatttaagtgcagtgggccacacctgtaatcccagctctttaggaggctgagcagggaggctgacttgaacccaggagtttgagatcagcttgggaaacataacaagaccctgtctctataaaaaaatttttaataaaaaaaagacatttgtactaagtttccagaatgcaaactccatacacaaatctcagtgcatttagtccagctaagtcaaaaagcaaaacacaaaaacaaacaacaaacaaacaaacaaaaacaaatagtatactgaattggtagccgcaagcctttggaagtaattttttagaagagaggacagcctaagaaaactaattttcttaagccaggcatgcttgctcatgcctataatcctagcaacctgggaggctgagtcaggaggatctcttgaggtcaggagttcgagaccagcctgagcaacagagtgaggccatgtcaatcaatcaactgagtaatccataaataaataatttaaaaaatgaaaatttcaaaaaacaaatgttacctgtcagcaaggccctcccaatcaggctcattacctctgcaaaaccaccctgcactcctcatctgcttcctggcagtgtccttctagaattcaataccacagacttattatttcatttgtctttctcttccatcagtgggatcagagtgtcagctccatggacacaggcgtttgtatgacttttgttcgcttttgtataagtaactcagacaagagtgctcaacacgtatttgtcaatttgggtctggctctcctgggacacgcgcagaagcatcttgcagtttctgagtgtgcctgagcaccatggggacagagtcaatagcaggttggtgacagttgctcctttcccctcttccttccctgaacaacgttagtgggtctggcctgtgaccccacatttgatgtggcgatttgtccccctgcttccacccttggacagaagagaaaatatcagtctctgagtttctgagaccagctgcgagtttgtagctgtgttaccagatgtaactagttaccttttttttgttttttgttttttgcttttattttttgagacagagtctctctcttgtggcccgggctgcagtacaatggtacgatctcggctcactgcaacctccacctccctggttcaaacgattctcctgcctcagcctcccaagtagctgggactacatgcacgtgccaccatgactggctaatttttgtatttttagtagagatggggttttgccatgttggccaggctggtctcgaactcctgatctgaagtgatccacctacctcggcctcccaaagtgctggtattgcaggcatgagccgctgcgcctggcctgtaacaagttccctttgaagcggttcaaaggttaaaacttccgagggctgccagttatcgtcctggtgagtgccccttcccgggtccgattccaaggtctccactgcaggctctggtatgttcagacgcagttcctggaggagaggccctgctggctctgagccgggaacccgccacgacgtgcaaagtcgagattgcaaagacagcgcaggtcacacatcctgcctgactccagattgcacgtcaccgtttattttctgtgccctgtgccagaaaacgagatatgtgccatatgctcgcttacttgtgaagactcagggattctacacacattgctggcattcgcacgcatagggaggtgtgatcgtcgctgacactggagcttccgtgtctgtgtgccaggaggctccgagatctttcccggccacacccagcactcacatatggtgttgaaggtgctgtaattctagacacagagcatatgtcctcggagcagacagggtgctaaattaattctaaacgtccgttgtaagtttcttgccgagatgctccctccctgtataaatagcgtctgtgctgcactttcctacagcaggctccacggaagcctagataacctgatttcagctttattttatagtattgaacattcttcaaaacagcccatctccataaagggaaactgggggaaatgatgatatgctaagccgagggacatttgctaagtctaactgggtgttctctcctcttgtttcaatagtgggcatctcggtccctgaaccctgaaggatgctctttggaatcttttttttttttttttgagacagggtcttgctttgttgcccaggctggagtgcggtggtgcaatcacagctgactgtggcctcgactgtggcctcaacctcctggggtcaagcaatcctcctgcctcagccttccaagtaactgggaccacaggtgcatgccaccatgcctggctacatttttgaatttttgtagagatgggggtcccactatgttgcccaggctggtttctaactcctgggctcaagcagtcctcccaccctggcctcccaaatggccagatctaaggagcaaaatttcattgtggttctttcattctgttgtctgggagaggctctgtccccactgaaacctggagtctgggcttctcagatgagtcctacctcttcttctgctgctgtaagtctgctccatatttatactggccccatgaatcacattggggcctcctctataaacctggaagacaccagctttaggaccagaacaaactagagtcctggcctgagggtgccaaaatgagatggaaaatgactctgtgtgtgtgtgtgtgtgtgtgtgtgtgtgtgtgtgtttagaggagtgcgggactgacagaggggcaggacccttaggctcagcctgagtctcaaggcttagcccccctcctcccctctccccacctcctgttccagcctctaattcaccactcatcttccccaggatgggatcagccaggaccacagtttgtccatgtggatatgttgtgggaattagaaaaaggcactcttctggttggacacagctctgtggatgcttagcccagcaagtggtcaatgctttctgcaaaggaaaagtctctccttcctcttggaagatgcagcttcatgcaggaacaaagagctcagtgaatggaggacaggccggatttcagctcctactcgccttcttagctggatgcctttgtgcagtgcacaacttggacaacagtccaaggcacgccagggaacatattaacttcctctgagtttagaagagacatttcctacttgctacagacctttgcagcaaattattttctccaagaaatgacagcaacagcatctcccatttcgtacgactttacaaggacactcctttcctgtggagatagggtctacattccatgcccttgaatctggaaagggtacgtgactacggcagaagtgatgtgttgtgactcctgaggctgggttataaacagtgtaaagcttgcccttggttctctggggggctcactcttggaacccagctgccatgtttcaaggaagcccaactagcctgtgtggagagaccatagggagaggccacccgtggtgtcccagctgacagatagcaccaactgccagacaggcaggtaaagaggcttctggctccttcctgccccagccatggagttggactcacccttcaagtctacccaactgaggccctaaatattgtagggcagagacaagccagtctgctgtgctttgtgcaaattcctggctcatgggtccataaacacaataacatggttcttttgtgacactaagttcagagttttaaaaatgacgcagcaacagtgaacaggacagccttcaaaactcactgctccctccttcaagaagtccttcctgatgcctagactatgtcaaaatattccttttttcattttcttaattaactttttttttaatttttattttttgagatacgatcttgctgtcacccaggctggagtgcagtgatacaatcatagctcactgcagcctccaactcctgagcccaagcaatcctcctgccttagcctcccgaggagctggaactacagacacacaccaccacacttggctaatttttaaattttttgtagatatgaggactctctgtgttgcccaggctggtcttgaactcttggcctcgagcaatcctcttgccttggcctcccaaagtgctgggattataggtgtgagccaccatgcccagccaaaataccccttttctgtagcctccctaatcccctcaaccaggtgaccagctcagagcccttttcactgtgcactgtctcactgagtccccacgtcactctgtgagtggctgttactatcccactttacagacaagggaatggaagctcaggctgggggcgttcccaaggtccacaggggctgaggggcagggctggtctcacagctgctgtgatgcagaaagtgagatgcgtgaaatcctccagtgcccgagtcctggcccttcccactggtacctgtagagctcctggtgaagactcctgacagaaaagcatgaagcctacagcccctcctgaatgtagcacccctcccatgaggttagatctcctcctgctccagagccgccccatgccagtgaggagaaggagaaatgcatgtgccgcgtcaaagccctccacaaacgatcaacacagccagaaggtgggtttccagccacacagcagcaagccggggacgtggctcccacacgtggctgaagggctgggaccttctggtctctcgggacagctggctccaggcaaggccagggtaccatgagagtatgaaatgaaacccttattgtcttggaggcttttctttgttttcacggacagctacaaagctcattctctttatagctctatagttttccataacgtgattgcattgtgactgatttaaccaaatcgtccttggaaacggattggatggtttctagtgttttgctattaccattgctccaaatcaacatctttctacttactcctttgcatattcatgcaaatgtttcttttctttttttttaaattttactttaagttctgggatacatgttcagaacatgcaggtttgttacagagttaggaacaaattggggaggggaacgtggtgactttggtcaggtgcaaagcctggggctgctgggctgtcaaggccttgcgggtccctgagagacactgccccattttcaggctcctctgggtgtcaggctgagaaattagaaccctggccttggctggcaacttcagtctctgagctactacaggatccttcctggctgggaaatgcatgtatctgtggactaggcttgggagccgtaaggtggagcctcaggcagaacggtcccttggacaatgaaaccctttttttccttaacacatcccttttgttttgtttgtttgttctgtttcgttttgagatggagtcttgctctgtcacccatactggagtgcgatggtgctgtctctgctcactgcaaccttcacctcccgggttcaagcaattcttgtgcctcagcctcccgagtagctgggaatacaggtgcctgccaccacgcctggctagtttttgtatttttagtagagacggggtttcaccatgttgcccaggctggtcttgaactcctgacctcatgtgatccacccacctcggcctctcaaagtgctgggatgacaggcgtgagccaccatgcccggcctaacgtatctcttgtgtatattgactttcaatgtcttaagtggcttgcatgttttttataaagtcacacaatacagcaatacactgtaagaaaaaattgcaaacagagtacaaaataaaaagttaaggccaggcccattggctcacacctgtaatttcaacactttgggaggcagaggtgggaggactgcttgaagccaggagttcaaggccagcctaggcaaccaaacaagaccccatctctacaaaaaaatagaaaattaaccaggcatggcagcacacgcctgtagtcccagttactcgggaggctgaggcaggaggattgcttgagcccaggaggtggaggctgcagtgagctataattacaccactgcaatccagccttggtgacagagcaagaccctgtcttctaataacaacaacaaaaagaataaaaagcttaaattccggccaggcatggtggctcacgcctgtaatcccagcactttgggaggccgaggcgggcggatcacgaagtcaggagatcgagaccatcctggctaacacagtgaaaccccgctactaaaaaatacaaaaaattagccgggcatggtggcgggcgcctgtagtcccagctacttgggaggctgaggcaggagaatggcgtgaacccggaaggcggagcttgcagtgagctgagatcacaccactgcgctccagcctgggtgacggagtgagactctatctcaaaaacaaaacaaaacaaacaaaacaaaacaaaacaaaaaggcttaaattcctcccgtattcccactttcactttatagagacaatcactggtaatactttaatctgcaccgtatagtcttttttctacgattttgcataggtatatgcacacatatgtgtacattcagataaagggttttatgtaagtccaattatactatttgcattctcataactttttttttcactgaacttttatttgttgtcttggaggcttttctttgttttcacggacagctacaaatctcattctcagccgggcgcggtggctcacgcctgtaatcccagcactttgggaggccgaggcgggcggatcacgagttcaggagatcgagaccatcctggataacagtgaaactccgtctctactaaaaatacaaaaaaatagctgggcgtggtggcgggcgcctgtagtcccagctactcgggaggctgaggcaggagaatggcgtgaacccaggaggcggagcttgcagtgagccgagatcgcgccactgcactccagcctgggcaacagagcaagactccatctcaaaaaaaaaaaaaaaaaaaaaaaagctcattctctttatagctgtgtagttttccataacatgattgcattgtgattgatttaaccaaatcttccttggaaacggattggatggtttttagtgttttgctattaccattgctccaaatcgacatgtttctacttactcctttgcatattcatgcaaatgtttcttttcttttttttttaattttactttatgttctgggatacttgtgcagaacatgcaggtttgttacataggtatacacatgccatggtggtttgttgcacctatcaacccgtcatctagattttaagccccgcatgcattaggtatttgtcctaatgctctcccttcccttgcgccccacccaccgacaggccccagtgtgtgatgctcccctccctgtgtccatgtgctctcatcgctcaactgctactaatgagtgagaacgtgcggtgtttggttttctgttcctgtgttagtttgctgagaatgatggcttctagcttcatccatgtccctgcaaaggacatgaactcattctttttttatagctacatcatgcaaatgtttctacaaaagaggccgaattggcgtcgcgaggctaagggtgtgtgcatttacatttttatataaccataagttgtcctctccagatgccgtgctgatgaacacctcctcccgttccgtaggagagcgcctcgcactccacactgcccagcctcacatgttctcaacgtcttcactctttccgagtctaacgggccccagttacgtccctgttattgctgtttgcagttccctatttaactgcttaggctgagcataatttcttgtgtttattgaccactcatatctcatcgatgacagcacctcttcgtgcctgtattaattaaagtgctttggagagcagggaacaaaaaaaccatgactcagctggcttggacaataagaaatgtgtctccttttttttttttttttgttagacacgaggtctcactctgttactcgggctgcagtgcagtgccacgatcatagctcactgcagccttgaccccctgggctcaagtgattctcctgcctcagcctcccaagtacctgagactacaggtgtgcaccaccaagcctggctaattttattagtttttgtagagatggggtctcactatgttacccaggctggtctggaagtccagggttcaagcaatccctacacctcggcttcccaaagtgctgggattacaggtgtaagtcaccacgcccagcctcagtgtcttcatttttttggagatggggtctcgctctgttgcccaggttggagtgcagtggtgtgatctcggctcactgcagcttctgcctcctgggtttgagcgattctcctgcctcagtctcctgagtagctgggagtacaagcgtgcgccaccatgcccggctaatttttgtatctttagatagagacagggtttcatcatgttgaccaggctggtcttgaactctggacctcaagtgatcctcctgcctcggcctcccaaagtactgggattataggtgtgagccactgcacccagcatcagtgtctctttttaagaatgaggacaggctttccttgccaccccctatacccccagcagatggacaagacaacatcactgtctatgacccaacctatcgcactgtggtggccacggtgaacccagactccccagcatagcatctgggcactcccttgaagcaagcatctgtagcgcactgaggacctgagaaaccggggctcccctggggtggggagggaggaacggccactgccatcagtaacaaacctgctcgctaccacggctgtggcatttttctgtggcattgtttgtctttttctttttgatttgtaggagctgtttatatatatttgaaaggaaatatatattcctttcaaaatacatatgttgaatcatatacatttttctttggtaagtgctaacaatatttttcctggcctattgctttgctttgagtgaattgtatttatttaaggccaagccttaactggaaggatactttttttcctccccaaatcttgacttcatgaataataacagctgcttctctcactgaaaaacaaaactggaggtggcagagggtgggtgaggtcatcgttatcggtttgcaggctttgaggcagagagcatctgtaggtagaggcagctgcggagaagatcatccagggaggctgcagggagcgcagtgctgctggaacctgcagcagggagactattaaagggtccaagccactgcagccccatgaggaggggcccacgcaggaaaagaaacggtgttgttagaacttaaagtcccgctgagatggtttccacctgggttcacgaagaaggctccagagacgggttcgttagatgacaaggctgactcccaggtggtgatcgcaaacacgaagacacatctcaagccacaggggcttccgggagccacacaggctgagattggcatgatgggcacaagatctgcctttgcagaggatgccctccctggcgggggctgaggaaacagcccatcaccttccttaggctcctgccctctttgtatggctctgggaggtagagggacttagctgacagttgcgtagtggaacggaggggatgcttggatccctcattggtctcattcaactggtacagagctcaggcgagcaggagggacattattatttatttatttatttagtggagatgaggtcttgctgtgttgcccaggtaggtcgtgaactcctgggctcaagtgatcctccctcctaagccttctgataagcgatcctccccaaatgttgggattacaggtgtgagccatcatgcccagcccaagaggggcattatttatttaatggggtttcatctgtaaccccaaatcccccttgccaatgccttgatgtctctggatacagaggtctcccttctggcagctggcctggagtcaataaccacagctcccatgtatgtgctggtcttgctgctccaggtaccgtgctgtgcaggtgtaacaactctatgaggctagaaacaccattgcccccattttgtagttgggaaaactgaggtaggaggaggccaaaaaatcaccaagcaatgctgctgctttctctctaatccctggtctctcctcctatttgtggaagcctttttaaatttttttgagatgatgtctcactctgttgcccaggctggagtgccatggcacaatctcggctcactgcaacctctgcctcctgggttcaagtgattctcctgcctcagcctccccagtagctggggtaacaggcatgtgccaccatgcccggctaattgtttttgtatttttagtagagatggggtttcatcatgttgcccaggctggtctcgacctcctgacctcaagtgatccacccaccttggcctccaaaagtactgggattacagacatcagccactgcacccggccagcagagtctttttgccaaaacgcaaggatggtctccagagtcccggtttctctgcagctggggaatacttttctgatttcagtctggagtaccagttttctgaagtgaggactgtatcggccaaatcttagaaggagaagatcacgaaaaagcgtctgcagaaagagaagaaaggggtggtacactgcggaggaggagggtccactccagaggctgcaggtgacacacgggaccccctccatggatgttgctatggtttaactataaatgtccctccaaaatgcatacattggaacctaatacccaatgtgaaggtattaagaagtggacctggccgggtgccgtggctcatgcctgtaatcccaacactttgggaagctgagttgggaggatcgcttgagcccaagaatccaagaccagcctgggcaacacagggagacctcatcccagtaagaaattaaaaagttagctgagcatggtgctatgctcctatagtcccagttactcgggaggctgaggtgggaggatcgctggagtccaggaggtcgaggctgcagtgagctgtgattgcaccactgcactctacagcctgagtgacagagtgaggccctgtcttaaaattaaaaaaaaaaaaagagatggtccttttgggaagtagttcagtcgtgaggaccccaccctcatgaatggattaatgcccttgtaataaaagatgcttcagagagcaacccagcctttccattccttccaccgcatgaggacacaacatttgtcccctctcaaggacacaacaacaaggcactgtcttggaaacagagagaagacctttcccagacaccacatctgccagcaccttcatcttgggcttcccagcctgtagaactgtgagaaagaaatttctctaatttatcaattatgcagtctaggatattttgctatagcatcatgaatgaactgagatggtacgaggcagggatgcagacaggttctaacgtgggggtggggaggccagactagagctggggtcgtgtctttggttggagaacgacaggcatattaaacaaagatatgaccctttgatttcttgcccaggggtctcgctacttcctctcacatcttgatatggttttgctgtgtgcccactcaaaatctcatcttgaattacaatccctataatccccatgtgtcaagggcgggaccaggtgaaggtaaccggattataggggtggttcccccatggtcttcttgtgatagtgagtgagtctcactgtcatgagatctgatggttttataagcatctggcatttcccctgctggcactcactccacgaagaaggtgcctgcttctcctttctcttccgccacaattttaagtttcctgaggcctccccagctatgcagaactgtgagtcaattaaacctctttcctttataagttatccagtcttgggtatttctccatagcagtgtgagaatgcactaatacacatctgtctaccagcactttagccatggatgtgtcaacatattaccttaaaatttgttcacaaggtaccaggctgggaagaaagtgcttcacctgtccctgacagcttttcctccatttggggcatctgcaaatatcttgaagttgtaggcagaaccgaggtgtgagtgaacacatgcaggtatgtgcattttttctgcaaaaataatccacggctttcatcagcctttcaaaggcatcctctgagaggctaagaagcattgttctaggttaatgatagtttccaaaatgggcaagaaacgagactcttaatctagagatcacaggattccaggctgcgcctgtgttgggtaacagcaggagaaaggtcaaaaccacccatcgacatcctgtgtgactttgggctagtttactaccctctctgagcattctcatttataaaaatgtaaacaaacacaatacctccttccagagcaggggtggggagtaaatgaagttatgtgcttagaggcccctgcccggggctccatctctccacctgcctgcttcctctgctgtctccagcaaaacctctctcctcttttcggtctgatcctccagcctgtgcattgtttctgtatctttgggattttttcttccttcccactgcacccaccctctggtcaatatcactgctatttctatttgcaacagggcaggagaaggaagtggtgaaactttctttaactttacaaccttggagcagccacagttgatatttggggaggaagaaagctgagattatcagcacatccaggtctgtgcttcccaatattcccgatgcttctttgtctactgactcctccctggtcatgaataattaaaactctggccatgctcaaatggcctaatgcaaccactacaagaaaacattggggaaaatatcttacaggctccagaaacaccacacccaaggaagatatttgcaagagcagatggtaacagacacaggttgcctcttcagcctcatcctggcttagggcagccatggccacacggttcccatctgcgtctggcccactgaggtgagaggaggttagctcgctaggcctgggcccattcatctcactcaggaccctaatgctggagcacatttgtgagccaatcagtccttgggccttttttcctttgaatctctactttgttaacattcagctctcatatttcctggtgacacacgaggtcatatgtatggcaaagcatcctctgaaatcatatcgtgctgtattgatattaagctaaagatatactgatctcgggttggttatctgttcttaattcagatgggaagaacaagacccgaagtggagatagttcaatcccctacccccaatttcccagccgcaccgcttaggtacccccaagtggcatcatgtgaccacttctggctatcacgtggtgaaccccaaaacttgggttcaccctgagatgccacatgggttcttggcttcatgcaggaaggaatttaagagtgagctgacagagtaaagtgaaagcaaatttattaagaaagcaaaggaataaaagggtggttgctccataggcaaagcagtggcatgggctgcttgactgagtatactgtcagttctttgttgctcatatgctaaacaaggggtggattattcatgagttttttgggaaaggggtgggaagtttcccaaactgaaggttcctcccctttctagaccgtataacataatttctgaatgttgccatggtgtttataagctgacatggtgctggtgggagtgttttttcccaagctaatgcattataattagtgtataatgagcagtgaggatgaccagaggtcgctttcctcaccatcttcgttttggtgggttttggctggcttcttgaccacattctgttttatcaggggggtctttgtgagttgtaccttgcaaaaccagtcctgcctattcttgtctcatttattcaagatggagtcactctggttggaaagcctctgacatggccactgagtaggtagcagacgtggtaggtgccacctctgggtggaagtattttagagctggtgcaagatgtccctggtctgtgttccctgccacgacaattgtgggggccacaggttgaggtgttagcattgcgagaaactgagaaccagagagaccgatacggagaacgggaggattgtttattttaggtacgcactggctcagtggattcgcatccaaaaagctgagcattgaacaacgactgagtggggtttttataagcagacttacaaaagtaaaacaaaagcagttaatcatatagtgtataatttgtggccttgtagctgcgtcaaaagaaaaacaagaactggctaaatacagacatttgtaaaacataatcacgtttaagaagcctgggaaaggagtaacagtaaagtaatttatctttttctctttttttttccttcaacattgctctgggggagaggggtgtctgaagcccattcctttggccttggctgctcgtacagcattatcttataactgtccttgaagtgtgcttgctaggcagaggaaaacttctttttttcttgtgaacccttgcctgttacttttcttggagtgaatgaatgcatatttatttttaaatttctgcctcattagagccacctatgaaagcagactggatcgctgagtcactcagtggaagcctgtttcaaaacacagtgtatcagtagaaattttgaggtatagtgaagccaacagatcaggagatgattgctattgaaaaagtagtttgttactcacagttcccaggaggaggggacaccgcctgccacgccacacagagccacacggggaagcaccaaggtcagttaggaggtggagggaaaagaaggctttgtttggtttgggtgggttgtttgcatctgaaaagtgctgtcatggcaacttgtatctctagaaattggctaactctagggggtcagcgaggccccagatgtcagagcattggaatgcaggaaataaaagatgtggttaataccaagacaagtgttccggagggctgcacaatctgcactggactttgtgggaggggaaattaaactttgttctgtgaagcattcatacttggggattcatttaccaccggcagtgtgctactgcaggaacacaggagaagcaggggcatgtgaaaaaacagcagtctcagcataggcatagcatctgccacactgacaaagttcgttcatttattcattccaatattcagccagtggttgttgagcaccagctgtgtgtcaggcctggggctggggactggatcacagagaccaggcactaaccctgctcccacagacctcttagtctcacgagaaaggtgacacatgtgaaaggacaaggatgggctggacacagtggctcatgcctataatcccagcactttgggaggccgaagtgggaggtgcttgaggccaggagttcgaggccagcctgggcaacattgcaagaccctgtctctacaaaaaagaaaaaaattacctgggcatggtggcatgcacctgtagtcccagctgctctggaggctgaggaggaaggatcgctttagctgagttggaggctgcagcgagctgtgatctacactccagcctgagcgacagagtgaaagcttgactcaaaaaaaaaagaaggaaggacaaagatgatagagtgtgaagactgccatgcagagctgggtctccagtgggtgggtaaacagaggagggagtgaatcagggaggacttctcacaggaagtgacacttagggtaggtgttcatggagttacataagaattccctgtgcagagacaatgggcacagatgttctgggatgtctaggaagcacatgtataagggcacgtccaggtctggcagagttcagtggggctggagcagaggagcactggggtatggtgagacatggctggaaagccagctgggttgacatctgcaaaggctttgggtgcactgacaagggctgcaggtgactgacggccatgcaggtgacattaggagattggcagtcacagcctttccttcttaaattcccctcacctccttcagtggctgtcctatcagatgattagtgttcatttaacccctcttgttatagttggggaagaaccccataagctcctctaatttaaggcagggatagtaaatgccatcctcccttccagcactcagggcagacatcagcaatcgatcgacattctttgcatcagaggccagattgagcctcagaggccttttcaacacagctcttcaggcaacaaatatccaagggcccaaattggtgtgcaagtcgatttatatgtcatttctgttttaagaggttaaggacgtcgtgttctctttctagaagtatttttactttagaaaaaagaaactgcagagtgaggacaaaatttagtcaaagaaattaatagctaatggtagaattttagtctgcagaagttttgggaaaggaagtctgtgcaagtctctcaatcctgtctccgttgtcacaaaaaaatgtttacgttgtttattttccaaggcaaggtaaacaccatggagcaagagacagttgtttccatggtaagctccacccacgatgtctccctttgtatcccccacaatgcccacaatcgttcaggcaaagaataggtgctcactaaatgtgtattgattgaatctaaattgcaattttatccaacaccctcagggaagccaactggaaactaaactcacccccatatattgctgaaacgcattgattaccaagaagccaatgtatgacagccccaacttgtgagacgcgttttttccaaagccacgtaaatcgcgatgtgtgcagcccgttgctcattctgtgtcatgcaccgttgccagccatttgctcttctcgttagctccgtgagggcaggggtcaccgttttcactgctcagcctcctcctgctcggcccagcccagggagacccctcagtccatacctgtgaatgaatgagtgacacttactaagcacagcgagatgaataattcatcattcctatccttcttcccaacttcctgatccaggatggcatagacgtgtgggaggcgcacatgctgggaggggtttgagtcccctgcccgaggttgcagagtgcctggggacgggggtgggggcatgctgggggcatttgcagaaagggcagtaggagagcagtttggagggaggtaaggcaggaagcactcagtcctgggctcagggactgtgacgtgctgctggaacctgcctggggagctcaggaatgaggggagatggcaaataaagacctggcatgaggctgggggcagggacagaaatcaccctggtgtccgaggaaggaaagtggaacgctaaagaggtgagacgaccagggaaagtgaaacaagagagaaagaagggatgtagaattggattattggggtggaaagaggaagccaggtgggggaagagtcagaggaggctcaggcagagggcaggaggggaattgggagaggacagcgagccttcgaaaaaatccggagctggcaccttcaacagaagccatggagcaacccaagaggagcctgggagacagcaacttggtggctgctgaaagacagtttcagctaaggggcaggagtgagagccagccagcactgcagaaggtggggggaaaggcaagcagcctagatggttccttcaagaggtttgtcgataaaaggagcagtcaataggacccaggacagtaagttcatttgttcttttaaacttttcttctctctgcttccttcctcctttcatttcctatcctttttccttccttccttccttcccttttttccttccttctcttttctttttccttccttttcttcccttaccttccccttttccccccctccgctcccgcttctcccctcccccctgaaccttcaggaacccacaccagcatgtgatctcgactcactctttttcccctgccctactgaaagctggctggggacctggagtgtttgcaacgacgcaagatgagaagctgggtcactgaaacattaactcacagaccagggtgggttgcagctgatccaacaggctggacagccgcatcaatgcttcctagaagaggagatgggaggagagagtgagcccaggagcctctgcgtggagaccaaggggccgaggagcacagaaagccccagggctacgcatcttgggtcaaaagtcgctgaaaagatattgatatctacttttctttcttttttttttttttcactgtctttttctggttttagtatcagggtaatattagcttcataaaatgtggtggtaagtgttccttcccctcctattttctgggagagattatgtaaaattattggtcactatagagattatgacatacatacacaacttaccacaagctactggtgttgacactgccactttgagtaagtgtagaaaccttacttccatttagttctctttagcttccccacttaaaaatatatgtgtcttgagtgtgttctttacatatattgaacatcacataagatgctgttacaatttttgcttcaatcatcaaatatgatttcagatactcatgagaagtatagtctgttgtatttatttctatttatgtacttcccatagtttgtttttcttttctggagctccaagcattcttgaaaccaatgagaaaagtggaaaaatctcagtccagaaatagaaggtataatttttaaataaaagcttctgttcagataacattctttacccaatctttaaagatacatttgccaacaataaatgctcttagtttttcttcatccaagaatgttttgctttctccttcatttctgaaggatgttttcaccagatacagtattcacagttgacagttctttttctcagtacttgaaagatgctgagccacttcctctggcctccatcatttcagatgggaaatccactatcattgcaattaatttttcccatgtcataaatgtgttatttctttctgactgctttcaatatgtttttgtctttagtttaactatttaattatgatgtggatttctttacatctagcctgcttggaatccactaaacttcttgaatctgtaggtttatgtctttctccaaatttgagaagtttttaaccactacttctttgaatacttttagtctcactctcttctcctttgggactcagaaggtatggctgttagctcttttcttattgtctcacaggtccctgggactgttatttcttccgtctatttttttttttttttgagacggagtctcgctctgtcgcccaggttggactgcagcggcgtgatctcggctcactgcaagctccgtcttccgggttcatgccattctcctgcctcagcctcccgagtagctgggactacaggcgcccgccaccacgcccggctaaattttttgtatttttagtagaggtgggatttcactgtgttagccaggatcgtctcaatctcctgacctcgtgatctgcctgcctcggcctccgaaagtgctgggattacaggcgtgagccaccgcgcccggcctattttctctctattattctgactgagtgaatgctattggtctgttcttgacttcacaggttcaatctctgtcatctctactctactatcaagcccatctagtgacgtgttttatttatctttttcctggttattgtgtttttcagttccttaattccatttggttcttttttataaccttgatttttattgaaattttctatttttcgtttgtttcaagagaattcataactacatttgaagcatttttgtaatgactgcttttaaatttgtgataatccctctgattcatttgcattttggtgcctgtttgttttttcattcaagttgtaattttccttttccttgacatgataaatgattgtctgctctatcctggacattttaggtattatattatgagagtctggatcctattcaacttttcttttttggcagactgtcttcctgttaagatgtagcgtaacggttgtgtattagtctgttcttgcactgctataaaaaaaatacctgagactgggtaatctataaagaaaagatgtttaattggttcacagttctataggctgtacaggaagcatagcagcttctgcttatggggaggactcaggaagcttccagtaatggtggaaggcaaacagggagtgagatgtctcacatggccagagcaggaggcaatgagaggggtggaggtgccacatattttcaaacaacccaatttcacgagaactcactattgcaacgagaactccaagggggatggtgttaaccattcatggcaaaccacccccatgatcccagcacctctcaccaggccccacctccaacactggagattacaattcaacgtgagatttgggtggggacacaaatccaaaccatatcaggttggatgagttgtatattcaacctcccactgggccccaccagtgctatcgtgacaaaagtgtagcactgatttaccctgcttcattgcaaatgggtggttggcagtgaactcccatctctgccttgatgataccttcccattgaaaatgcatcatcggcttgcactgtcttattgtatccaagctaccctgctaggctctgctgacccagagatgggagaaccagagaactggctcccactgttttgttgtggcagagtggggcagaagctcagctctccactggcccctgctggtaacagggtaagagagaagggaactcttatgcttctttgttgtgtcatgtccagagatttttttttttttagttgtaagatggtggactcaggagaaatggggctactctatcttgtctagagttagaagttcagctttctatctcctctgtttctttacctgtaaaatgggaacaatactacctactctacctacactacagaacaattttcagaattaattaagaagttcatgtgtatgaaagtacactgggaaaatgttatatcatgttatgttagtagactgttatttctgagactagggtctggcaagatgtagcttgagaagagataggataagtggcggggcacctccatattcatctatcaatttaatgttggtgaaaacaaacttgacagccagaagccagccttctattgtttatttccctgtttcttttgagtctgtggtgacctttgtcttgacaagcaataaccctggagaaagctagaggaaaaacaaagattagggtcacagcaaggagagagcaataaagtagctttaaagagcctaagaaaccaggataattgaatatagtaaggattgtggctgggacaaggaggtgtctacaacatcattttcagaaaaacaatcacaaaagaaaaataacactggagctgggagggaaggaactagttggaaagggaacccagaggagaaaggaacagcctctcagaatagtcagcaatgactctgccttacttagaggttatgggacagggctaccaattggagtgacctcagtattaccaatcaggatgacatagatcttgtgcacttttggcccctgtattagtccgcttttgcactgctatgaagaaatacctgagactgggtaatttataaaggaaagaggtttaattgactcatatttccacatggctggggaggcctcaggacacttacaatcatggcagaaggggaagcagacatgtcttacatagcagcaggcaagagagagcgtgcaagagcagggaaaagtgacttataaaaaccatcagatctcatgagaactcactatcatgagaacagcatggaggaaactgcccccatgatccaatcacctccctccctcaacacgtggggattacaagtcccttccttgacaactagtgattacaattcaaggtgagatttgggtggggacacagaaccaaaccatatcagccctcattccaggcaggcaaagggctctggattaagatttgggggaccccttaacccctgtgagcctcaggttttccttctacaagatgaaactggtaaaggtgccaactctgcttggttgtttgagggtcaaatgtggatcacccaacctgttcatggttggcaatcaatatatatagtagttccctgcctgatcacagccccagaaattttggcctctgtctaggctggacgctgactgtgggaggttcctctctaagagcttacgtgctctgccgtcatttcctgtgttttctggcccatagttgggaggggcatgccaaggtgaccatgccctaatttccctttctaaatcgtcttcattgcagtcttctggttcttctttctcttctttgtcccaggggtctccattgaactcactgtagggggtggggactctggaggcctggtcctgggggctgatcctgaggaaggggcattcctaggccagagtgaggtcctggggtgaaccacagaggaagttccatctcccaccccactctccttgtcttgaggaagttgactttaaataaagcccaacacgccccgctaaactgccagctcagaagacagggtctgtgtctgtcctgttcaagggtgtcccaccccacaccccttcccccatactggagtgctgtgctggagtcagctcctgccagctcagaagagtcaattcttacattttcaggaattttgcaaattgcttgttaaacatagccattattagaaattagactggctgggtgcagtggctcatgattgtaatcccggcactttgggaggccaaagcaggagggttgcctgagtccaggagttcaaaaccagcctgggcaacatagggcgacctcatctttactttttaaaataaaaataaataaatacacataaataaatgaaaatacaaattagactgtaaaagcctacaattaaataaattttattgaaaacaaagataatgaatattcaaaacatatcactccttaattattttgctgtttgctctgctctgctcttggggtttgcacctattatatccgcagagtggagattctgtaccatgatgtgctagcaggcatctcttcccaagtctgcatatagtgacaccatgttggcagcttgatattggccatggtgggagtattcacaccacaggaatcagcagacactacaaaccagagcttgccctattgtttggtttgttgtctagatttaaggaagggatggagaaaagtattaatgatgtagattaaacataaaagcatgtcattgttaaagtgtaaacagcacagagaattttaaaactgtttttccagtatttcataactattatcagggcctggcacggtggctcacacctgtaatccaagcactttggaagtccgaggcgggtggatcacaaggtcagaagatctagaccatcctggctaacatggtgaaaccccgtctctactaaaaaatacaaaaaattagccgggcgttgtggtgggtgcctgtagtcccagctactcgagaggctgaggcaggagaatggtgtgaacccaggaggtggaggttgcagtgagcagagatcacgccactgctctccagcctgggcgacagagccagactctgtctcagaaaattaaaaaaaaaaaaaaaaaggattatcagatcagattcagcaaggaagtctattatcatattcagcaaggaagtctctcatgtcatcgacaaaggagtcaagttccagcgtgcacttttgttgttttacctttatcttacttgttaacataaatgaaaatattagccaccgtaatcatggtgagtaatcatggcaggattactctcgtagagccggttgttaaatagttactagcacactattgtctggtgattagaatagtaccttgcttagaagacatgcccagttgtatgagtctgttctctcactgctataaagaaatacctgaggctggataatttataaagaaaagaggtttaattggctcacggttctgcaggctgtccaggaagtacggctggggaggcctcaggaaactcacaatcacagtggaaggtgaacgggaagcaggcatgtcttgggtggctggagcaggaggaggagagaggaggaggtgctacacacttacagacaaccagagggccaggcgcggaagctcatgcctgtaatcccagcactttgggaggccgaggcgggtggatcacctgagctcgggagtccgagaccagcctgaccaacatggtgaaaccctgtctctactaaaaatacaaaattagccggccatggtggtacacacctgtaatcccagctactcgggaggctgaggcgggagaattgcttgaaccaggaggcagaggttgtggtgagccaagactgcgcccctgcactccagcctgggcgacgagcagaactccatctctaacataaaataaaaaataaaataaaataaaaaaacaaccagatctcgtgagaactcactgaacatcatgagaacagcaaggaagaaatccacccccatgatccaatcgcctccaaccaggctcctcttccaacactggggattacgatttgacatgaactttgggcagggccacaaatgcaaaccctgttaccaataagtaccttctgaatgactgaaaccagtgaaaacaagctacaacggacatgtggggccaccccaccccttttgctttagcagcattggccttgcacattttgggtgctgtctgcctccccattcttgctccaggcgcctttgcccgtgttcacttgtgctctggcccagggcttctaagctgtactattcatatgaaacacctgggtgtcttgagacaatgcaggttctggcccaacaggtctatggcggggacaaagattctgcatttctaacaagatcccaggtgacgctggtgcttgtcacggagcacacattgagcagccaggttctagccaccctgccctccttcccatgtgccaagatcagggtctccacgtgaccttcgaacttgccacaacctttacctggggcgctgttctccctggtcttcacatgacctgcttccatgcaacattggggtctctgttcagacatcacccttcaaaaacaaagatcttttcctgactactcatgcaaacgtagctccccatctcagttctctgcataatgttactgatagtttctagttgatgtgtcgtcagctttcctccctagaatgcaggctccacgggagccccccattcccactctggtgactttacaacagcacatgcccaaaaaacaagtgttgaatgatcgtggtggtgatgtcacaaggctaagggtggagagagctggcatgatactggggatggaggcagtgatggaagggggatggttatagctcaaatgcatgtaattttcttttcttttgttttcctttcttttcttttctttccctatttgtcttcttttctctttttttgttttcttttttagagacaagaccttattctgttgcccaggctggatcacaatggcacgatcatggttcactgcagtctctgactcctgagctcaagcaaccctccccactcagtctcctgagtagctaggactacaggtgtaaaccaccatgcttggctaagtttctctttttgttttcagagatggggtctcactatgtcacccaggctggtcttgaactcctggcctcaagtgatcctcctgccttggcctcccaaagtgctgggattacaggtgtgagccaccacccctggcctaagtttttcttaaataatagacacaagaaccctttactcaatcacttttgttcctccacagtcacgacccactaccaagagtgccagccccaggccaggccaggcgtggtggctcatgcctgtaatcccagcactttgggaggccgaggtgggcggatcacgaggtcaggagatcgagaccatcctggctaacatggtgaaaacccatctctagtaaaaatacaaaaaattagccgggcatggtggtgggcgcctgtagtcccagctactcgggaggctgaggcaggaaaatggcgtgaacccgggaggcagagcttgcagtgagccaagattgagccactgcactccagctgggcgacagagcaagactccatctcaaaaaaaaaaagtgcaagtcccacccctccactgtccccattcacttccatgttgtgtgcagaagaaagagtaaaggaccccgaccaaggctctgagtaagggctgcagggtgccagttctcataatggtttctctagagttttgcacaaacaagacgaatggggccacagacaggcagcacccaggggtgcattctggctgggccttgtgcccagggcaggtttctccatcgtgttttatttccagaactaagttgagccatggctggtgctgccttccacgtctgactctgccaagaagtgcctggagcccttgttttcggggaggaagtatctctggtgggttttgaagtttctgtgtgatttctcttaacattaaatcaatactggaagtgtcttttgttatttttctgtttatggagccaatgctttaactaatatcagcagataccacatgctgaatggccctgttgtatgccaggcctacgtttcatctcattcaatcctctcaacagttctagggaacccaatctcatgttatcccattttcgagaggaggcacttgaagctaagagaggttaggtcattggcctgaggtaaaacaacagttggggttagtcagtactgcaggggtcgcaaacacaactgcctagagcagttgtgctttgcaggccagacagtgtctgtgcagctattcagctctgctcatgaagcacaaaagcagccttggaccatctacaaacaaatgagtgtaactgtgttctaataaaactttattaacaaacacaagtgtggggccagattgggcccatgggccatagtttgctgacctctcgcctagagaggccagtagggaaaatcaatgggtaaaacaggccaggagcaaagaataccgaggcgcttccttgttctggcttctcttcttcccagttttgatggaggcaagacaccgtgcaagtgcatgatgcctggctactggcacagtgacgtgtcagcaggtggcaggaggtgagggtggtccccaggtgttccaacaacaaacagtagccacacccaacttcagctgcctgctgctgccagacacacagccaatgtggccagtttttaaaagaagccacaagcctggatttgggagtgtgtgtgtgtgtgtgtgtgtgtgtgtgtgtgtgtgtgcatgcatgtgtatgaaataccacctttctttctatgttggctcaaatcaataaaacaaaaccagaaatcctgtgcaaaccaagtagaagacatccaagcatcgcctctggccctcagaccagcagtttacaacctctgcactccgaaaaccccccagacaacgctgtatttattaagtaataattcatctgtttcccatattttatttatcaaagacctcagtaactgtcaagtagaacttcttatcatcaggaaccgatcggcagacaagtgttacctcccagactgatgatcaatcttggcaaaccgggaaaccctgacattttaattagctggaacattcttatcagccatcaatcctgaacctgccatttcgcattgtttgtgagcccctaattgggaatccctgatttggtttcctcagggccacctcattcacgtgaacatatcctcattactttactgtggcagccacccctagattattcagcacagagccaacaccatcagagcgacagcgaccacctcaaaatgtgctcgccgtgtagcctcctgagttgctgacactaaaaaaggaaaaaatgggcttctgtaggctgcagcaccagcaaaaacaaaaaacaaaaaacaaacaaacaaaagaaacaacaacgacaacaaaaaaaaaaaaacagaaaaaaaaagtttttgtgcacaaaacgacgaacgatgccagactcagcaaggtggtagatgaaacatctcctcttatttggggtcttggtgaagtttcataaccctgtatggggactgtactgtgtaaagacactttcagttactctcaatgcaccgtgaaaccacagataaagatgatactggctgggtgtgatggttcatgcctgtaatcccaacatttttggaggctgtgttaggaggatcgcttgagcccaggagttcagaccagcctggcaacatagtgggaccctggctctactaaaaataattttaaaaattagctgggcgccgggtgaggtggctcattccagtaatcccagtactttgggaggctgaggtgggcagatcacctgaggtcgggagttcgagaccagcctgatctacatggagaaacgccgtctctgctaaaaatacaaaattagctgggcgtggtggtgtatgcctgtaattcaagctactcaagaggctgaggcaggagaatcgcttgaacccgggaagcggaggctgcagtgagccaagactgcaccattgcactctagcctgggtgacaagagtgaaactccatctcaaaaaaaaaaaaaaaaaaattagctggccatggtggcacatgcctgtagtcctagctactggcaaggctgaggaaggaggatcccttgagcccaggaaatggaggctgcagtgagccatgatcatgccactgcaccccagcttgggcaacagagtaagaccctgtctctttaaaacaaaaaaaaaaaaaaaggaaaaggagtaaatgaacaacaataaaccatcggaggtggtttcatacttcttccgaatagcccatgtttagttgatatggacttgtcaccttcctgagcctgctagagggattttctcggtcatagccatttttcgttccagctctacccccttgggagagaaacaacccactgctgcccctgttgtctaagcagccatggtttctatcatgctgtaattgcccaatgagttcttcctgcccactgtacagacgaccaattcactgagaccttgacattgcaataagaaacagtttaatcgacatggggtcagccatgccacatgggagacagagttattactcaaatctatcttccccaaaattcagaggctagagtttttcaaagatagcttgacaggcagggagctagaagaataggtgccacagattagttggggatgcaatcactggggtgtggaaaatggtcctcgtgcactgagtccaattctggatggggccacaggaccggttgagccaagactcgagggtccaggtgggaccatctggtcatcagaaacgcaaaagcctgaaaagacatctcaaaaggccaatcttgggccgggcgtggtggctcatgcctgtaatccccgcactttgggaggccgaggcaggcggatcacctgaggttgggagttcgagaccagcctgtccaacacggagaaaccccatctctactaaaaatacaaaattagctgggtgtggtggcacatgcctgtaatctcagctactcgggaggctgaggtggaagaatcacttgaacccaggaggcggaggttgtggtgagccaagatcgtgccattgcactccagccggggcaacaagagcaaaactctgtctcaaaaaaacaaaaaacaaaacaaaacaaaaaaaagccaatcttaggttctacaatagagaattgaggaagttgcaaatcttgggacctctggaaccatggctggcaattgttttgttttcttttaactcttattttaggttttgggggtacctgtgcaggtttgttacatagataaactcgtgtcatgggggtttgtggtacagattatttcattgctcaggtattaatgctgggtgatgaaaaatagttattttttctgctcctctccctcctcccactctccaccctcaaggtgacaccagtgtctgttgttcctttccttgtgttcatgagttcttatcatttagctcccatttataagcgaaaacgtggtatttggttttctgttcctgcattagcttgctaaggatagtggcttgcataactaagcctatactctagcagaattcaggctcctctcatcctcctaacctggtagactttcattctttttttttttttgagatggagttttgctcttgttgtccaggctagagtgcaatggcacagtcttggctcaccgcaacctccacgtcccgggttcaagagattctcctgcctcagcctcccaggtagctgggattacaggcatgcaccaccatgcctggctagttttgtatttttagtagatatggggtttctccatgttggtcaggctggtcttgaactcccgacctcaggtgatccacccgcctcggcctcccaaagtgctgggattacaggcgtgagccaccgtgtctggccctttcattcattttataaaggcagtttagttttggggaagggctattatttaaactataaactaaatttcccccaaagttagcttggccctaggcccacgaaggaccaagggcagtttgagattaagggcaagttggggatttgttagattagatctctttcactgttataattttctcactgttagaatttttgcaaaggtgatttcagtgcagcctcaccaggcccagccccagaggtgagggcgtgacagtgggcagcctatccaggggtgaccagcaggccgcagtgcagtgtcactggatgagaggggccaggcagagtccctctaatgggaaaaactgaaagaagttggttggaggtgggctccaggtctgccaggccactgagtgtgggccatctgggggccaagttcaaggcaaggttatggatcagcaaaaagtaggaggagacagagtcagggagaagctccaggatggaaggaaagagtcactgatctcctaaaggccctttttttttttttttttttttttgagacggagttttgctcttgttgcccaggctgaagcgcaatagtgtgatctcggctcactgcatcctctgcctcccaggttcaagcgagtctcctgtctcagcctcccgagtagctgggattacaggcgcccgctaccacgcctggctaatttttatatttttagtagagatggggtttcatcatattggtcaggctgatctcaacctcctgacctcaggttatctgcccacctcgacctcccaaagtgctgggattacaggcgtgagccaccgtgcccggccctaaaggcccatttctaacatgctcctccatggagtccctttccttgagcctggctgggtggtgcaggagggcctctgtttcttatgaatcgagaaagccatcaggaacaggcataccccaggcgttccagagaaccacagttcttgggagatctcgggagatcttgcacaaggtcgtcccccaaccttgtcaagtgaaaaagacacttggatgtcataaggagagactatctgaaagggttattacaagggggagggggatggctcttgcaatggagggagggggattatttcaatagggggactgttctgaacataaaatctgcaaaaatacttttcctgttttttctttagagactgggtctcgctttgttgcccaggctggaatgcattgatgtgttcacagctcactgcagcctcaacctcccaagtagctgggactacaggtacacaccaccacgcctggctaatttttaaatgttttgtagagataaggggttgtctcactgtgtttcccaggctggtcttgaactcctggtctcaagtgatcctcccaccttggcctcccaaagtgctgggattatcggcatgagccactgtgcttggtttttcttttgtggggagtaataagaccagaaagacccagtgtgaggaagtgacatgaatgtgtccacatggtaggtcagggtcggttttatcctagggcagccgattcttaagggtctgcgggcttaccccaagggcgggcctgaggaaggaggaagtttcaccaaagtttggttctcaagcatgttgttcccagtgatcagtggagacaagcagttcagctgatcattagtgaggcaaggagtgggaatttggagggtctgtgtctggcctggttgtaagcacacaaggggcacctgtgagcctcatttaagcatctaagtcctgctgttatagtgggtggctagttagatatgagcggcgcgattagagggctccccacaccccagggtgcgcacacacacacacacacacacacacacacacacacacacacacggagtgttgggcgaccatcaggtgatgatcaggcagtttttttgttttgttctttcaagacggagccttgctctgtcgcccaggctggagtgcagtggcatgatctcggctcactgcaatgtccacttcctgggttcaagcaattctcctgcctcagcctccagagtagctgagattacaggcatgtgccaccacacccagctaattttttttttttttttttgagacagggtctcactctgtcgcccaggctggagtgcagtgctgtgatctcggctcactgcaacctctgcctcctgagtccagggattctcctgcctcagcctccccagtagctgggattacaagcacccaccaccgcatcaggctaattcttgtatttttagtagaaacagggtttcactatgttggccaggctggtctcaaacacctggcctcaaatgatccgcccccacctcggcctcccaaagtgctaggattacaggcctgagccaccacgcccggccaggtagttgttaactgttgctgtaaagtaataattggtcacagctggtgccggggaaggcaaggtcctaatagaaaacacctgaaactgatcagcagcttcccagtaagatcccaggagcagggagaagtaacgtaaggttctggaagtgttccaatatgtaaaatccccagtcaaggccaggcactctggctcacgcctgtaatcccagcactttgggaggccgaggcgggcggatcatgaggtcaggagattgagaccatcctggccaacatggtgaaaacccatctctactaaaaatacaaaaaaaaatagccgggcgtagtagcacatgccttagtcccagctactcaggaggctgaggcaggggaatcgcttgaacccgggaggcggaggtggcagtgagccgagatcgtgccattgcactccagcctggtgacagagcaagactccatctcaaaaaaaaaaaaaaaaaaaaaaagagaaaaagaaaaaaattccccagttaagaggccgagctgcatacttggtttctcagggcacctgctggaccctcttccgagtcttactttccttcttttcttgccttcctttcctttctcttctaaagctttgtaatacattttcactcctgctctgaaacttgcctcggtctctccttctaccttatgcccctcagtcgaattctttcttcttcttctttttttttttttttttttttttttgagacagagtcttgctctgacacccaggctggagtgcagtggcatgatctcagcttactgcaacctccgcctgccaggttcaagcaatcgtctgcctcagcctcctgagtaactgagattacaggcaccttccatcatgcctggttaatatttgtatttttagtagagatagggtttcaccatcttggccaggctggtctgaaactcctgacctcctgatccacctgcctcggcctcccaaagtgctgggattacaggagtgagctacctcgcccggccttgagctctttcttctaaggaggtgagaattgaggttgctgagatctgtacggattcgccaccggtaactcagctatgtcacaccagtaacactgcagacaagggagttccttgccatgagccgttttccagaacacaaaaggatgggtggcggggagttcttgtccacgctgcctcccaggagcctggggctcaggtaaaattcaacattgtctatgggcatggtgacccacttgtaatctctgcactttaggaggctgatgggggaggatcacttggagcccagagttcaagaccagcctgggtaacaaagcgagacccccatctctataaaaaatttaaaaattactcaggcatggtggcaagcacctgcggtcctagcttacttgagaggctgaggcagaaggatcacttgagatcaggaggtcaaagctgtaaagagctgtggtcgcgcaactgcactccagcctgggttacagagcaagaccctgtctcaaaaaaaaaagcaaaaaagactgtcacctccaggagtcgctaaaatattccatgccttgtggatattatacaaaaacaaaattagcacatttgccagaagccatctgttgaattctttaggcctgtggtcccagctacttgggaggctgaggtgggaacatagcttgaggccaggagtttcaggctgcagtgagctatgatggcactactgcagtccagcctgggcaacatagtaagacccgatctcaacattttaaaaagtagctaggcatggtggtacacacctgcagtcctggtacttagggggctgaggcaggaggattgcttgagctcaggaggtcaaggctgtggtgagttatgatcgcaccactgcacttcagcctgggcaacagagcaagactctgtctctacaaaaagaggccttccaattgttaaagtgaactaaatatggcctaagaatgactctgtacttctatatctgagtccttgtggacaaactgcaacctagcttaataggcagacaagactgaaaacctaacttaggagtctgcacctgcaacaatagctgagtcttggccaatcccagcagccatagttcaaccactcatacactgctgagtgttcaaactgtgttcaaataaggcaaatgccaacctgtaaccaatctagctgttttgtacctcacttctgatttctgtacatcatttccctttatcgtctataaatcttcttctaccacgtggctgtgctggagtctctgtgaatctgctgtgattctgggggctgcccattcgcgaatcgctcattgttcaattaaactcctttaaatttaattcagctgggccaggcatggtgactcatgcctgtaatccccgcattttgggagaccgaggtgggtggatcactcgaggtcaggagtttgagaccagcctggccaacatagtgaaaccccgtctctactaaaaatacaaaaattagctgtgtggtggtgcgcacctataatcccagctactcagggggctgaggcaggagaatcacttgaacccaggaggcagaggttgcagtgagccaagatcacgccactgtactccagcctgggtgatagagactttgtttaaaaaaaaaaaaaatgaatttggctgaagtctatggagtccttctcaggccatatttagttcaatttaacacagtgataccctggacccatggcctctccccttttcttgacctctcccaaccaaccaacaacagactctgaccctagacaccaggttcttttgaaaaaccccaaatcgcttccattgtgcaagtcagcctgtagacctggtgccgggaactgtgttgccacagttgcagaaaactcaaacctatttccaagtgacaataaagtaatatgtattatccatctttttgtacccattgtaactactgaaagttccataggctcgactgtgtgccggacactgctcaaagcacattatccatatgaatggatttatgggatctaaacaacagcccgtgaaggtagaagggcttatacccattttacagatatgagaactgaggcccagaaaagttgttatgggcccaaggtgacagagctgggatttcaacccaggcagtcttgccccttggctgggatattctttaccccacactccccattctcaaggccatagcgtagcaccaccttgcttcccctaaataattatttcccacttctcggcaggtggtgtggaatcaggatctccatcatgacgttagtgatggcttttgccgtggaggtgagtgggcatgtctgttctctaaaatgctgcagaaagaagcatcagattacctccaacgcactgtgtctagaccagtattgggaacataggtgcttttccttataagaggttttcagagtaaatgaacttgagatttcattaagatagctattgtgtaagaaaactggcctgtctggctggacaggttttgtgttttggggtttttaaagaactacctgttttaaaataagattagtatcaatttggttaccctctctctgcaaagaaatcaccagtctcagaggctcctacatgtgctaggcggaggcattactgtggctgctgcctgcaggcgttgtgacttgggggttcaccctggagataaaacagtgtcagtgtggggtcagttatcccaacagtgaggtctgcctgccgataattgagtcctactgtgtgctgggcactgggttaagcccctcacatacctcgtcgctaactcttacgataatcccagagtgtatcatgattaaaaacttgtgcattggagtggcccagaattgggctaaatccccagtttacacttaatagctgtgtgacctatagtaggttgcagtcccctctgtagacttcagtttcctcatataaaagtgggtatcctaacggcatcagcttaacagggctgttgtgagaataaatgaaatcatgcacgtaaataaagcatgcctataaagcaatgactacataaatgttattctaaaaatagtcatccttatcctcattgtgcacaagaggaaaccgaggttcagagaggtgaaatgacctgcctccaaactgcaaggctagtagctggtggaaatggaatttgcagatccagatttaaattctagcatggaggaaacaattaagcagtgggagtggccaggcacagtggctcatacctgtaatcccagcgctttgggaggccaaggcaggaggatcgcttgagcccaggaatttgagaccagcctgggcaatatagcgagacccccatctctacaaaaaacttaataagttagccaggtgtggtggtgtccacctgtagtccctctactgaggaggctggggctagaggattgcttgaacccagaagttccaggctgcagtgagctatgattgtgttattccagcctgggcaacagagtgagaccgcatcttaaaaaaataagtaggagatagtaacaatggtaacagtgactattattataggctaatggctgcaggcccaggaacctgagctgacccccatcgtgactaacagcctactgcaactgcaagagtcaggctgactgtgataagggattgctgaggaggaagggcttgcaaggtgattatcagaagcagtggcccctcaccttggctttgccctctttatatgcaggtgaagcagagggtaagctaaaccttacctgaagcctcagaattcttctccatttacagacagcgctgctaccccagcctgaaatttaaaaaaaacccagcacacatactcagggaaacacatcaggaatttaaaagatcttccagggatgatgtgagaccccttgattgataaaaataacagtgacagagagaccgtgtggcgtagtggttgggctgggaatccagctctgccactgactggctgtgcaacttcgggcaagtttcttttttttttttttaattttctttttttttttttaattgagatggagtcttgctctgttgcccaggctggagtacagtggcgtgatcttggcttagtgcaacctcggcctcccagattcaagcgattcttctgcctcagcctccagagaagctgggattataggcgcccaccaccacacctggctaatttttgtatttttagtagagacagggtttcaccatgttggccaggctggtctcaaactcctgacccaggtgatccacccgcctcagcctcccaaagtgctgggattatagccatgagccactgcacccggccaactttgggcaagtttcttaaccttcccaagcctcagttcccccatccataaaacggggatgatagtagttcctatgtcagagagttggggtgaggaggaaatgagatgcttgcaaatgcctggcccctaacaaagcccacaataaaatttagctatttgcaaaagtgagtccctcttggctcccagggaggctgaggtaacacttgtcaagggtgggtgggctgattcaggggtactacattcgtgttgtcttgtctgtatggtagaaacatcaagtcccactcctaacctctcagaagaaagtgagtaaatgaagaccctaaagttacaccagagaaaacctgtcaattcccgcaaccttccttttgccctgcaccctttcccatcccccaaagtacacttgacccctctctaaagtggctgaattctacagtactctggggagaaagtcaagttcttagctatgacgttggtcttttttccccgcttttgttaaaagaaaaaatgatgagaaatgttcctttcttgcattcctgcaccatctcctctttctcttcctcaatttcttaggaacgaaatcacccaagatataaataaaatgttctaaataaagctctgcctaactgcagcgtaagacatgtctgtgtacgtttgtgactgtcagccaaaataagttaacctccgatggaagtcattttcatgtaattaattattcttgtcgcagctgaaagagacaggtgcattattggtgtactttggcagaacttctgggtgaacttaagaagtctgcatttcaaacacaccaaacaactggagtgcagctttggcttttgttctgatattgtttcttgacttggaacctttatttctcaattactgcaaactgaaaaaaaaatgaaaacaaaagaacagacatcaaaggcattctgaagtacaggaggtacgtgatgtgccaattaagcaacaggaatgccgtctattctgcaacagctgatgttttcattctcccactcagaaaaggggtttaggttgtttggggttttacagaaaagccacttgtgatcgggtaagtctgttattagcaagagttttctttgtgtcatggaggtcaaagtcctggcatgttaacatttttgaacaagaaagaaacatagcaggatgaaagagagactggccaggtgaatttgcagcttgttgaatgaaactgttcaaatacggactattacggagttgagggtctctagcggaatgccttagggctctttccttagccttctgaaactatttgaggctgaccaaagggggaaatgccaggaagctgaaggaacagtaactgctgggtgacagaattagatcaacccactccaaagactagtatgatgggcctattgaaccagctgttttccaaaataaatgttttagaaaatagctgttttccgttactttcaatggcaaaaactgcaattacttttgtaccaacctaataaattcttgccaaaacaaacaaaaaagcccaaaaccgaaacctacagcatatgaagagttaacttgaaagctaccttacaatcttaccctttctaagacatttggtgttaattgctcttataagcagtatggaattatattttaaatccaatttgatatttaacaggtgagtttgaccgaatcgcatttattgtaattgctgttatattgggatttaattctatcatcttattttgtatttttctattgctatgtttgtctccctctctttttttttctatgaattgatgaaatttttttattctcatttttttcttctactgttttggaaatgacagcttatctttctgttctttcatcagtacctgtacatttttttaaaatgggtagtttgtggccctaagaaggataagacatcagtttgaaaagagaccctatcagagtagcatgaattctgctaaaattgaagcaggaacaaacatcaagtttatgatgaactttgggtgaaagaatggtgaaatcattgatactttataaaaagtttatggcaacaatgccacaaggaaatcagaagtttacaaatgaataagttgttttaagaagggataagatgatgttgaagataaagcttgtaccagcagaccacctacatcagtttaccagaaaaaaattaatcttgttgatgccctcattgaaaaggaccaaagagtaacagcagaaacaatagcccacaccttagatatctcacttggttccgcttacacaattctgactgaggaatcaaagttgatcaaactttccacttcatggataccaaactgttgcacccagataagctacggacaaggacagagtttcagtggaaattttgagcaagtgggatcaagatcctgaagcatgtcttcaaagaagatgaaacatggcttcaccggtaaaatcctgaagacaaagcacagtcaaagcaatggctaccaagagggggaagtggtcctgtccaagcaaaaggaagagtgaaccactcataagcaaaggtcatggcaccagctttttgggatgctgaaggcattttgcttgttgactttctgcagggctagattacaacagcgtctgcttattgtgagggtgttttgacaaagttagccaaactttagcaaaaaagctctcaggaaagctttatcagaaagtccgtctccaccacgacattgcttctgctcattcctctcatcaaacaagagcaatcttgtgagagttttgatggaaaattactaggcatccaccttacagtcctgatttggctcattctgacttctttttgtttcctaatctaaaaatcttgaaagggtacccattttttttttcagttaataatattaaatatactgcattgacatgggtaaattcccaggatcctcagttctttaggaatggactacatatcatcacctacaaacacgtctttaactggatggagcttgtgttgagaaataacgtttacatttcttatttttatcttttaatttctttttcccataaagtttttgaagttccttcatatttttattttgtgctcacactggagcaataacttatctgggtataggattctagattgacagttgttatttctccacagttttgtgttttctggcaactaatgatgagctgtctgcctaattgtctttgctttgtaagtaatcaatatattctccctggcagctctgaacctcttcctgtctatccctagtaatctgtagtttcactaacattgtctatgtgtgagtttatttgtatttatgttgcttggcacaagatgcaaaatttctaactaaggacttcatatgttttcacaaaaataaacttgagcagataaaaagacaacccttgttcttggacaagatgactcaataccatatagatgtcaattctcctcaagttactatgtacatttaatataatccataaaggccaggcacagtggctcacgcctgtaatcccaacactttgggaggccgaggtaggcggatcacttgaggtcaggagtttgagaccggcctagccaacatggtgaaaccccgtctctactaaaagtacaaaaattagccaggcatggtcgtgggtgcctacaattccaggtacttaggaggctgaggcaggaaaattgcttgaatccaggaggcagaggttgcagtgagctgagatcacaccattgccctccagcctgggcaacaagagcgagactctgtctcaaaaaaaaaaaaaaaaaaatccataaaaataccaagttttttttactggagttagacaagttggtttgaatgttcaaatggaaaaataaacatgcaaaaatagaaaaccatttaaaaagggcaataaagattgactagccttccagatagtaaaatatattacatagcctctatactaagagtgtagtcctagtacataaatagaaagaccaatggaacaaaatagaaaatccagaaataggcacaaggacatatgagaatttagtatgtgataaaagtgacatctcaaatcactggggaaaagatagattttttaaataaatgattttgtaatacagatttgaaaaaaagataaaatcaaattcattgctccaactgtaaactagagtaaattcaaagtagattaaaagtttaaatgtaaataataaaactacacggctgctttttaaattatggatgaattcatttgtaatctggatatgcagaaatctgttttaactatgatgaaaaatccagatgcaataatttaaaaccttgataaattctattgcgtgaaaaatacaccatgttcatggtttaaaacattaatgtgagcaaagtaaaatcaaaggaataagaaatgagaaactgtggaacataattacaacctatactacagataaggagctgaaaaccttaatacgtaaaaaacatttatttatttattacttatttatttacttatttatttatcaagacaggatctcactctctcacccaggctgaagcgcagtggtgcaatcatggctcactgcagcctcgacctccctgtgctcaggtgattctcccacctcagcctccaaagtagctgggactacaggtgtgtaccactatccccagctaatttttttgtattttttgtagacagacttttggcattgatatggtttggatctgtgtccccgcccaaatgtcatgtcaaattggaattcccggtgttggagatggggcctggggggaggtgattaaatcgtggttgcaaatttccccttcggtgctgttcttgcaatagtgagtgagttattgcaagatctggttgtttaaaagtgcgtggtacctccccgatctctctcttcctcctgctccagccatgtatgaaatgcctacttctacctaaccttctgccacgattgtaagtttcctgaggcctccccagctatgcttcctgttacagtgtcaaccacgaaccaattaaacctattttctttataaattactcagtctcaggtatttctttatagcagtgcgagaatggactaatacagccatcttgcctaggctagtatcaaactcctgggctcaagcaatctgcccacctcagcctcccaaactgctaggattatatgtgtgagccactatgccctggccataaaaagctttttaaaatggagggataaaaggccacagacaattaaaaaatgagcaaaagacataaacatctagtttataaaaatcaatatacaattatccttttagacattaaaaagatgtcaactttactcttaagggaaatagaaattaaaactagtttacactgtagtacaatttcttacctttcattttggcaaaaattcaaaaccttgatattttgttggggggaatgctgtttaagcccttgtgcacgttgctggtgggggtgcaaaatgtataaaccctatagcagggaatctggcaatagccaaccaactataaaaccttttctctttgattcatcaatcccacttttaggaattcaccctgaagatacacctccacaatacgaagcaaaatatgaataagccagctgtcacacccttatttctaatagcaaaatactggaaacaacctaaacgcctattcataggcgaaagattgaataaattatgatgaatacacacaatagaatactatgcaaaaacaatgaggaatctctaagaactctgctgaaatgatttccaggatccattgttaagtgaagaaagcaaaatgtaaaagagtattataatatgctagactctgtgtgtgtgtgtgtgtgtatgtgtatatttatttgatttttcttctgaaatggaacacaggaaagataaagcagaaattaatgaagacaattatccatgaggtttaagggactggagtggaagtgataggaatagaaatgagactcctctgagtacaatttttatagttgggttaatatctaccatatttataactgttttctattcacagccctgctcttttttcttaatttctttctatctttttcttttcttttctttttggcattcccttctttttatatcttctctggttttaagtgagcattttatatgattcaattttctcttacagcatttcaattatatttcttttaagaactattttagtgtttgcagcatacatttacaactaattcaagaccactttcaaataatattatactgtttcataggtagtgcaggtaccttaaaacggagtactcccaatttcttgttcacaacctttgtaatattgttgtcatacatttcatttatatccataagttataatcatccaatacaatattgctgttgtttttaacaaagttatatattagatcaattaagaataagacaaataaatgattttttattttatctttatttgtttgttttctaatgctcattctttcttcacgtagatctgaatttctgacctgtattactttccttctctctgaagaacttatttttagatttcttataaagtaggtctactgatgacaaattccatcagtttttgtttttctgagaaagaaggtcttcttcacttttaaaggttaattttgctggatagagaattactgattggtgtattgttttttcttattttactccactctcattttgcttgtatagtttctaaagggaagtctgacataattcttatccttgtttcccttcaggtaaggtgttttcttcctctgacttctttcaagctgttctctttgttttctagtttaaatatgacatgcttaaaggttttttatttgtttattttgttgttgtagttatttgtcctccctgatattctctgaagttactgaaactgtggtttagtgtctctcgttaattttggagaactctcatgcattcatatttcaaatgttttgtctattcctttctatgtttactctccttctggtaatcccattacatgtatttacaccttttgtaattgacccatcattcttgaacattctgctctttttttttttcattctcctgttttctcttcacattccagtttgggaaatttctcttgacattttttcaagcttgctgattattttcatagccaaatccagtttactgatgaacccattaaaaaattatttctttctgacacaatgtttttaatttctagcatttcttttagattctatattagcatgttcctatctctgtttccaattaccatgtgttgttgcctgtcgttcgcttttttccattaaatcctttagcatactaattgtagttatattaaatgcccagcttgacgatttcaatgtctatgagtctggttctgatgcttgctttgtctcttcagactgtgttttattgtgctttttagcatgcctgcaattttttgttgaaagtcaaataagatgtattaggtaataggaactgaggtaaataggcctttaatttgaggttttatgcttatctggatgggagttaggctgtgtttaatgtttgctatagctgtagctataggtgtcagaggcttccttgtttttttctctcctgttgtctttgtgtttccctagaaagattatttttaaatagagtctgtgtcttgaagctgtatcagttgtaatccattattattatcctggaaccctgttgatgttgtggtaagatactgaggagggaagacagtctataatcttatgattaaatcttagagtttttttttttttaaagcaaaacactgctgaaagaaataatagataacacaaacaaatggaaacacatcccatgctcatggatgggaagaatcaatattgtgaaaatgaccatactacccaaagcaatctacagaatcaatgcggttcccatcaaaataccatcatcatttttcacagaactggaaaaaacaatcccaaaattcatatggaacaaaaaacaagaccacatagccaaataaattctaagcaaaaagaacaaatccggaggcatcacattaccaggattcaaattatactacaaggctatagttaccaaaacagcatggtagtggtataaaaataggcactcagacaaaaggaacaggttagagaattcataaataaagccaaatgcttacagggaactgatcttcaacaaagcatacaaaaacataaattggggaaaggacactacctattcaataaatgctgctgggaaaattggcaagccacatgtagaagaatgaaaatggatccccatctattaccttacacaaaaatcaactcagaatggatgaaagactgaaatataaggcctgaaaccataacaactctagaagataacactggaaaaagtcttttggacattggtctaggcaaagaattcatgactgagccccaaaagcaaatgcaactaaaacaaacaaacaaaaacaaataaatggaacataatgaagctaaaaaatcttctgcacagcaaaagctatagtcagcacaacagataacccacagagtaagagagaatattcacaaacatgaatttaacaaaggactagtatttagaatctacaaagtacttgaacaattcagcaagaaaaaacaaataatcccatcaaaaagtgggtaaatgtcatgaatagacatttctcaaaagaagatatgcaaacagccaacaaacatatgagaaaatgctcagcatcactaatcatcaggaaaatgaaaattaaaaccacagtgagataccaccttactcttacaagaatggccataattaaaaagtcaaaaaccaatagatgttgtcatgaatgtggtgaaaagggaacaattttacactgcaggtggtcatgtaaattagtacaaccactgtggaaaacagtatggagattccttaaagaactaaatgtagatctaccattcaatccagcaatcccactgggtatctactcaaaggagaagaagtcactataagaaaaagacacaagcacacacatgtttatagcagcacattcacaattgcaaagatatgaaaccaatctaagtgcccactgatcaatgagtggataaagaaaatgtggtacatatacaccatggaatattagccataaagaggaatgaaataatgtcttttgcagcaatttgggtagagctagaggccattattctaaatgaagcaacccagaaatggaaaaccgtatttcatattctcacttataaatgggagctaagttatgaggatgcaaagacatacagagtcacataatagaccttggtcgggggagaggttgggaggagaggtgaatgatgaaagactacatattgggtacagcgtacactgcttgagtgacaggtgcactaaaatatcagaagctgccactatagaactcatccatgtaataaaaaaccacctgtatcccaaaaactaaaaacattgaaataaaaaaataataattaaaaaaatcagagttgtttttttttttttttttttttttttttagtgagcctgaggccctgtgctgtgaccttcagaagagcctctcaggcttttttttttttttttctctgcttatgtaggcagggagctagagttggctgcaggtatctaattgcccctgcctagattccagaacagattctggaagttttccttgagagtaggactttgttgctgagaatagaatactctgggtatgtatatatataaagtgctgggattacagacatgagccaccatgcctagcctgggtatatttttaaataattactttttgcttcctcctgcctgaagaaagagatgtttctcctgtcttcgctgggagaacctggggagtctcctggatgtaaaacccataaaagtataggggttcctaagactgggaccccaggagtttgtaactccccagttataccatgttcagtgtgcatcaattactcaattacattttaagcgttcctaccagttactggctccagaagcttctgctccccataggctgtgatttatcatattcacctgtgtttccaaatgccaaagcagcattctgaggcgtgaccttaattctattacagatctaagaagagttgttgattttcagttttttcagctttttttcttgttgtaaggatggaggtgaaaacttccaggctctttatgtgtcagagctaaaactgaaagtctgtttcctgtttttcatttctgttttcttattcctgccttcttgtggttacttggtcatttaaaaaatttcattttgatttatttatagtgcttttcaatgtatctttatagatttattagttattgttctaggtattatattgtacatacataacatttcagtctactggtgtcgatattttagaagatcaagtgaaatgtagaaagcttacttctcagctgggcatggtggttcatgcctgtaatcccagcactttgggaggacaagacaggcagatcacttgaggccagtgttttgagaccagcccggccaacatggcaaaaccctgtttctactaaaaaatacaaaaattagccaggcatggtggcacacacctgtaatcccagctacttgggaagctgaagcacaagaatcacttgaacctgagaggtggaggttgcagcgagccaagatcaccccactacactccagcctgggtgacagagcaaggccctgtctcaaaaaaaaaaaaaaaaaaaaagaagaagaagaagaagaaatcttacttctctttttgtccctttatcctcctccttttatgatataattgtgtctacatacattgagaatcacatcagagttataatttttgtttcaaccatcaaatataatttagaaaactcaagaagagaagaagtctattgtgttctttcttctttcctgatgttccaagatttcttattttatcatttagggaaattccactggccatttttttagcataggtctactgctgacaaattctcttagcttctcttcattcaaaaatgtcttgatttccccttcatttctgaaagatatttttgctggatacagaattgtagatggataggtttgttttttatttcagtgctttaaaatgtgccacttccttccggcctctgatgagaaatccattgttagatgaattgtttctcttttgtaggtaaggtctaatttctctcttactgctgtcaagatatttactattttctttttaaaccaaagagtttttatcaacttgactatggtatggattgctttcagtttatcctatttggggtttacttagcttctgaaatctgcaaatttatgtcttttgtcaaatttgaggatttttcagccattattcctgtgaacattttttagccccacccactgtctcctctccttcttggactccaatgacataaatgttagatcttttgtagtagttctacagagttttaaagctctgtcctttttttcttctcttttcttcagcgtattttctctgttgctcagattgggtaatttctattgttgtatcttcacatttactaattctttcctctgtcttctccattctgctgttaagcccatccattcaggtttaattttggtggttgtattagtttgttctcacactgctaataaagacatactctaggtaatttataaaggaaagagatttaattgactcacagttcagcatggctggggaagcctcaggaaacttacaatcatggcagaaggggaagcaatcatgtccttcttcacatggcagcagcaagaagtgcagagtggaagggggagaagccacttataaaactatcagatctcatgagagcttactcactattacgagaacagcataagggtatctgccccatgattaaattacctctcaccgggtgcctcccacaatgtgtggggattacgggaactacaattcaagatgagatttgggtggggacacagccaaaccatatcagtggttgaattttccagctttaaaatttccgtttgattctttgcttatgccttctatttcagtgctgagactttctgcatttgcctgcatttcaagtgtgttcatcactgcttgttgaagcattttataacgtgtgtgttaaaatcgttgtcagataattctaacatctgtgtcatctcaatgctgacatctgtcttcgtttgctagggctgctgtaacaattaccacaaactggtagacataaaacaacagaaatttattgtctcagtgttctagaggccaggagcctatgatcagggtgtcggcagagttggttccttctggaggccctgaggaagaaaccgtcccttccagctttcctaacttctggtggctgctggcatctgtggcttgtaaatgcatcactccagtctcagcttccatcttcacgtggccttcttctctgtctcttcttcttatagagacactattgattgaatttaggatccaccctaaatccagggtgatttcaccttgagatccttaactaattatatctgccaataccttgtttccaagtaaaataacatgctgaggttccagcggacgtgaattttgggaggatgctatttaacccactctagtgtctgtcaatgctcttttctcattcaagtggctatttttctggttcttgaaacgatgagttatatttgattgaaaatggacatttgggatattatgagactctggattttatttaagtcttctgttttaagtagacctttgctgacacttatttagctaacaaaggggatgctcccttgttacttccaggtggggttttcccaagtggcctccaaggacaccagagggacaggtgctcttcattgctgctggctgagggtgtggcctcagcttctccaccaggcctctgttgacaacaaactggctgacaggcacatggggacttccttactccctttcatgcgatgtccactttcatggcatgaaggtggctttgaaccactggatggtggtgaatatttcgatttttccacttgtctcttctgataccagcgcagcagtggggtggacgggcacgtcatcctaccaggcatgagtggaagtccaagctccccacatggtctccaatgacactgctgagttgggctttattaccactaggctggagtgcaagttctggcttcgcactcagcctttgctggtgggagcgtgagtggggccatgcttgtttctgtggtgcttttctggtgtggagtggttactgtctaaaattctttcatcttgccaggctgcctctttcccgatcctccggcaagaaaaagcggattttccttggcgctttggtttacctttgtctttgcctgttggtgtttccagcttgccatgttttcccacacccaatccgggatatgagacacaaaaggaaaacttaaagaactcactactttgtcatttcttggttctgaggtccctagaacgtctgccttcttctctccatctctcagtgtctttctgtttgttttatacagaacgtccagggcttttagggaaagtacatctatgtcatcttcccatacgtggaagttcctatttctaggattttaaatttaaaaaaaaaatctttctttttaattcactcttacctgccaagcttttgttcattatcttggtctcattctatgggtgttattttctcctttatctctgaggattatacttacacctacttaaagtccttctttcgttttttttggtgtgtgtgtgtgtgtgtgtgtgtgtgtgtgtttgagacagagtctcgctctgttgctcgcgctggagtgcagtggcgcaatctcagctcacagcagcctccgcctcctgggttccaacaattctcctgcctcagccacccgggtagctgagattacaggcatgcgccactacacctagctaacttttgtatttgtagtagagatgagctttcgccatgttagccaggctggtctcgaactcctgacctcaggtgatccgcccacctcagcctcccaaagtgttgggattacaggtgtgagccactgcacctggccctatttaaagtccttttatggctgctctaacatttgcatgtccttggtagccatgagtttgttgatcatcttctacaaggtgtgctttggattttagtttgagagcttatcttgaatagaagttgtgtgtgtgtgtgtatgtgtgtatatgcatatgtgtgtgtgtacatatgtctgtatatgcatatgtgtatgtgtacatgtgtgtgtgtacgtgtgtgtttatatgcatatgtgtgtgggtgtacgtgtgtgtgtgcatgtgtgtgtgtgtgtgtgtgcatgtacatgcatgtgcgtccccttcctaggatcactcctctctgaccagcagtttttcagttgtctccatctagctcactggattcctgagtaactaggccttatattggaggcttaggctttttgtcccaagggacaggggtagggtatgatttggccccagctcagctcattcctgctgccttaggaaactgccctgggccactgctgcaatgttctatttatgggtggaaacagtttccccagactggactcaatcctggattatatggagacaattctgtcccccactaccttgcaggatttaactctcaaagaatctgcatatttttaaagaacagttaagtcttataatatgtttttatattttattcattatttctatgattttggagatggaatgaggaaagttttgtgtgaactcatgatgccatttttatgggaagtaaccttctcttcccacccaccgctttgaacgtgaagctcagtttcagggagcctggatggctttggtgttttggtgactatcttaattagcttgtatgcaggcatttgctcaataactatattaagtctggataatgatagcaatccatttggaaggtaatttactgataactttagatttttcaatcaaaaaccttaaattgcaaaattacatattttgggcatgtattaggtaacaaaagtaaagaggcaacaaagaatctttgaacaacattgaacttcctgctctgaggcagaattatagtatttttgtaaaatcacaaagagaataagaggatgtgatttttttttctctctctctctcttaaaggcaattttgtttctccagcataaagtcgggtctgtaatccctggagccacgcagggttcctgctacctgtttgtcctgattgttctcattcagtccaggtgatcagccaagatatgttttgatgaaaatagcaattttgctcacccccaacccacttgcttttgtgtcccccgtcactacctcaatttggccgtaattgtaccgctcccataacaacagccaaataactggatatttgtggagggcttataacagggttgtccacaaagccactggcaacgccaaacagaccctgtatatcagcatctcacaagagagacagctatccgggggagcaattcttggcagctcccaatcaaacttgcagctgactgctgattacctctgcgtttccaatctgaggcacagcaccccatatttctcccacatttcctccgttacactcagtctcaggaccatcattccctcatggcctgcctgggacattaaaacaatgcacacacagaggaaaacacacaacaaaaactctttctctgcattgagagcaccaaattgcagcaaagatcagggaaccacgcggtctcagggctgtgcttcaggttgtgtgctagctatcagcaccaagaatcaaaacatctttatgggtatggatacagattccctttttgctgagccactgtgtgattttggggagcacgttcgctgatcagggttatgagagctggatggagaggaagtcgcctttgttccggcctgcacgtcatgtcaagcgaagttagatatttccctaccgacagctattttgatctctcagtactaaagagaaccgctgcaggtaaccctgaagttgaatcccacattctgtctgagtttaggactaggactttgcaaattgacagctcacatacttttgctggtgtgcggccaacacagagatgggcttcagtcaaattcgggagagggagggagggcaatggagggggagggagcggcaggggtggcaagaggagaaggcaagaggagaaggcaggagcaagggatggtgcctcctgcccgtcttcaaacgcagactcacagggtttggaggtggccgcagtgtcacacctggagctacagatgtaacagccatcagagggaactgcaagcacagagcccagtcctcccacccctgcccctgaagaaagaggtggtggacaaccacctctggtgtctctggcacccaggtgggctgggcagtggggtacctgacacctggcagcaaggtgggccctaaggcctgcaggcctcaggttggccccttagaaatgggtgtcaaagggctgggtgtggtggctcacgcctgtaatcccagcactttgggaggccaaggtaggcagatcacgaggtcaggagatcaagaccatcctggctaacacggtgaaaccccatctctactaaaaatacaaaagcaaaattagccaggcttggtggcgggcacctgtagtccaagctactcgggaggctgaggcaggagaatggcgtgaacccgggaggcggagcttacagtgagccgagatccaccactgtgctccagcctgggcaacagagtgagactccgtctgaaaacaaaaaaaaaaaaaaaaaaaaagaaagaaatgggtgtcaaatgtgtccctttggatgaaaattaagtttttaacctaaacagggataacgtcaatgtttcacatttgtaggaactactgccgtttccaagcaattgctttgttttactaatgatttgatcaactccatgcttttggctatatgtttgctgtctgattgtgccaagtgtggaccccaggccagcagctttggtgtcctccagagcttgggatagatttggactccaaggccctccccagccatcctgaatcagaacttgcgttttaataagatgcccgggagatccgtggcagggatgaatcatttccctgtaagatgtgctttggaattttagtttaaaagctcatcttgaataagtgtgtgtgtgaagctagaggggtaggctgggccttgtgcactatgatagtttggctttcatttttcaaagcactggaaagctattgaagagttttacacaggcttgatgacatgatcagacttggaagtaatctctctgtctgcagtggagcaattggactggaagggatcagcatgggtgcagccagaagtcatgaggctactttaggtgaaatgggggtagcttgaacaaatgtcatggttgtggtagcggtggtaatggtagtagtgatggtggtggtagtggtgatggtgatgatgatggtggaggtggtggtgggttgattgtggaagagtggtgatactggtatggtggtgatggtgatggttatggtggtgattgtggtaatggtggtggagatgatggtggtaggggtgatggtactcgtggtaatgatggtgatgatggtggtaatggtagcgatggtgatagtagtaattgtggtggtaacggtggttgtggtagtgttggtggttgtggtagtgatggtggtgatggtgataatgatggtggtggtaatggtagtagtgatggtgatgataatggtggtaatagtggtggtgatgatggatagtggtgatggtgattgcggtggtagtgatgttggtggtgttgatggtaatgggagagatggtggcaatggaaagaagtagaaatttacacaatacttaaaaggtaaagtcaacaaaaattagtgattattggaaatggaagatgaagaaaaggttaagtcaaatttattttgtaaaaagcttagtgctgtcttaagttgctcttggttagttgaacatgcacatttgttcatcttctttctatagacagtttaatactgtgcctcaaacagtcacattcagtctccaaaccaccaccaccagcacactacaagtgttcttagctgctgtggtggattaaagatgactgctcattctttgacaatccttccatcaagagatggggtctattttcctttccctttaatctgggctggcctatcactgctttggcaaatcacttatgggagaagtgatgtgtagaacttctgaagctaggacataagaagctgtccagcttctgcttgggtctcttggagcactctctctggaagccctgagctaccatgaaagatatctgaccaccctgacaccatcaagcttgaggggccccatgtaggtgttcttttcaatagtcctcatctttcagctggactcaccaaagccccagataagtgagaaaccccttcttggaacctctgtattggttcatctgggagctgagtaaaactgagtggcttcagtcaaagccacatggagcagaagaatcacccagctgagccctgttcaaatcaagcccactgtattgtgagatagaataaatggatgttgttgaaagctgctaagttaaagggtaatttgttaggcagcagtgactggaacacctgcttttccatatgtgacaacagaattagagtaataactcctattcttccttaccaagcctattcttcacccactctgaccagtagcatagcatgcataaacaagggtgtattctgggatgtgaaacagaaccattttagctattagatgatgcagatagagaaaaacaatacccagtgagtgacttagtgggtgaggcctctcttccctaccccacccctacccctggcatcttgttcccagcctgaggagttgagactgctatagtggatgatccaactaacagcctggtccctggggggtgccatgatccattgccttgtaactgggggtatttaaattactcaattggaacagttctccccatggaggagattaaattccaagtaacagaagtgaggggtgcatgagaagtgagaggacaaaaatctgtcaacagtgctattcctcaccaaacctctgctcattgaaacaatggctcctcagtgattctcagactgcaaaagcatatccaactttagaggtgcgcaaaatgagggaaataaattgatgactgcacctggtaactcttaaaacctctgtatggtccagctatgttattcttgttaacattttcattgtaaaatggcatttcttcccaggataaaagctcactgaaacgatgccttcctgggagcatatgtacgaacgtcacactctgccaattttatatctgattaaaacctcaatacatcaaaacatcctttgaaataattaagagcatttctccattaggggcacgaagctaaatgtgtccaaatatatctgaaatcagcagatggaactaagggaattaatagagtagtacgacattttgcaatcatctaaaagaaaacagaatttggcttgcaaaggatatactttttcatttggggtaaaatgaaaaggatatactttttcatttggggtaaaataaggtgcattttccactcgcactaagcaccccattcgtacatgaatgtacatgtaatacatgaagtacaatttatctccaggttgttgaagggaaagccatcattttcaggggttctgctgctccctgggaagggagcctccaagacagttttgatccattgatgagtgctgtctaatgtgctccctgaggtacagtttccctaaatctgttagacttttacagtcgtccaggatctgcagtctggagatgctccatcatactgtattaacttgacaacgtaatgtactgctatcttttattttcataggaagtactaggtttgaccttgaaactcttaaccacactttataatcctcagcccatcctggcaaaaaagaggccatcctaacaaatccatcctggctagacttgagtctgtaaaacgttggattggaatgcataggactaggggaggtgggagagtaagtaagggtcttgacagctctgtctcaatcttcaggggcaaatgaagtgggggaattgaggagacatgagttacgttaccagctacagttcactgagctcttaccacgtgccgagcactgtgctttacgtgggttattctagtcacttctcatgaggctgacattgttcttgcttcatatatgagggtattaatcctttttcatgctgctggtgaagacatacccaagactggtaatttataaagaaaaagaggtttaatggactcacagttccatgtggctggggaggcctcacaatcatggtggaaggtggaaagcacgtcttacatagtggcaggcaagagagaatgagaggcaagtgaaaggggtttccctttataaaaccaccagatcctgtgagacttattcactaccatgagaacagtattggagaaaccacccccacgattcatttatctcccaccaggtccctcccacaacatgggggaattatgggagctacaattcaagatgagatttgggtggggacacagccaaaccatatcaatgaggaaactgaggctcagagaggttaagcaacttacccaaggtcacccagctagtaaatggcagagcccggattcaaactcaggtctttttgactcaaaagccaaagctcttaagcatgattctatgatgactcattctgcagtgaaatctctgctcttgagaataggaagtgggcttggactgcacttgactgacttggtgccttcatgggacatggttcagtcattcctttcacttgccatcagcccatagctggacatttccttcctgggtccttcttgaggagcacagagtccttccctggggctgggagttatatgtcaggtcttctttcctgctctagagacaccccatgtgcccccagagtgggaaattaaaagggcctgaaatggtaccttcatgcaagtcacctggatgctgagcctactcagagggcttccctgtgtgtttccctgggccatttggtctatactcaagcactaggggacgtctgaaaggccctgacctctgcagagagcagtgtctttgggtggttgtatggagaccccagagaccaagcagaaggtgaacagtcacccacccgatggtagacatgggcactggcttgggggattattgtacagatccatggtgggtgctcccaaatttgcttcttcctgcaaaccataaaggcttttaattattaaagaatgattcttgaggctggccaatttatcagcctctggcaagaataaagagtcaaccagccatgaatcctatctgattactaataagaacgacataaaatgacacaagtgctgagaaatgctctcggttgggctccagccaaggcagacctggatcaaatgagcccaggttaaaccagctcccactttccccggttgccgagtggatgcggaacgttctgttccgaagggcagatgcttacatgctcctagcagcagaggaaagtaggcaaagctggtttctggcatgggccacatggctcttccctcccaggagcgttctcacttcctccaccaacgaggctcccccgcagctgcctctgtgcatctctttgccccaggcctgggccccggcattctgcaaggggaacttggagccaggacggctgggtttaaatcacatcataaacagcccctcacgtgtccatccacagatgaatggaaaaacaaaatgtggcatatacatataatagactattattcatctataaagaggtataaagcgctgatacgtgctacaacatggatgaaacttgaaaacatgctcagtgtggccaggcacagtggctcacgcctgtaattccagcactttgggaggccgagaggtgggaggatcagttgaaaccaggagttcgagaccagcctggcaacatagcgagaccctgcctctacaaaaagtttttaaaaaaaattagttaggtgcggtggtgtgtgcctgtggtcccagttactcaggaggctgaagtgggaggatcgctggagcccaggaggttgaggctggactgagctatgattgtgccattgcactccagcctgggtgacagagcaagaccttgtctcctaaaaaaaaaaaaaaaaaaaaaaaagagagagagagagaaaacatgctaaggccgggcacagtggctcacacctgtaatcccagcactttgggaggccgaggcgggtggatcatgaggtcagaatttcaagaccagcttggccaagatggtgaaaccccgtatctactaaaaatacaaaaattagccaggcatgatggcagacatctgtaatcccagctacttgggaggctgaggcagggaattgtgtgaacctgggaggcggaggttgcagtgagccaagatcgccccactgcactccagcctgggcaacagagggagactccatctcaaaaaaaaaaaaaaaaagaaagaaaaaaaggaaaaaaagaaagaaagaaagaaaagaaaatatgctaagtgaaagaagccagacacaaaaggccacatcgtgtgcaattcctgttatatgaaatgtccagaatgggcaaatccgtgaagacagaaagcagattggtgattgtcagggggcgggggtggggcgaaaggaggaacgactgatgaaggggtaggagtttctctttggggtgacgaaaatgctttggtgctagatagaggcgtggcacaacatcatggatgtactaactgccactgaatggttcactttaaaatggtgaattgaatgttatgtgaatttcactccaataaaaaacagaaacaagtcacatcagggtgctccttcaacaagcacttcctggggaaaagccttgagacccacgagcggtgagccctaaggcaggctgggatctgggagcgccgtcgtgtcctgggagaagttcagtcccagcgggctccaccacccacacccgctccttcctcctttgaacgcagaggctctggcgacggtggcaggagccacgcagagcggtggagcttccagcgtggagaggggcactacaaggacctgcctccatgcagctgctgaatccacgcccgttgcttggtgtcaccacctcctaagtttttgttattgagaagaatagattcgtatttgttgaaggcacactgagaacaagtcaacagaagcagtcatctgcgagagcttgctgtgggccccgtgggagactcgcaatatggtgggagacggatttagaaacaaacagtgatgatttttgtgcattaagtgcaacgcgagagctggaatcaggctgggcccggtggctcacgcctgtaattccagcactttgggaagccaaggcaggcagatcacttgaggtcaggagttcgagaccagcctggtgaacatggggaaaccctgtctctacttaaaatataaaaattagccaggcatggtggcgggcatctgtaatcccagctactcagcaggctgaggcgggagaattgcttgaacctgggaggcagaggttgcagtgagctgagatcgcgccactgcactccaggctgggcaaagggatcgaagctccttctcaaaaaaaaaaaaaaaaaaaaaaaaatagagctggaatcagaggcatgtaggagcccagagaaggggtccctgaccatcacccaggtgaggggcccttaagccatggaaggcttccctgagtgcctgaggagagtcttggggcctgaggaggagcgggaggtagcagagaacagagatgacagtcagagaaaggcctggaggagaaaccctgagtggcccacacaggagcccagccacctatgcaggaaacagataaccagctcggctttgcaagagtgtagtgtgcatgagatttttaaaacattaacatcaatatctacaatcttctggccaccctccgtgctggcctttgccatgctgacctgggcaaggggtggaggggacaaggttggaaagccagggctggctgcatgtctccacctgcggaaggagaggaggtgggcttcagggagaagagggggcaagggagtggcatttgaggattaatgaagagagacaaggaaatgagatgaggggctcccgtaaggacttgggctttgaagggagaggtgtgaaaagtgggtttttaggacagccctctgcagctgtaggtcttccgaaagaagttgttagtaaagactctcactaggtcagtgctttttggagggggattttctgttggttgcactgctggctgttggagagagtccctattaaaatagaaaatagaaggcccagtttcctttggcttatggtgaggtacaaggcagggctgaaggaggtgaggcaggtggatacacagagtttcacacctcagaggatctcttgggcctggaacttttctgtacacagaagggaactttgggatcttgaggaaattttagcttctctaatgctcagtttcttcttctttttctttttttttccttccttccttccttccttcctctctctctttctttgtttctttctttctttctttcttcctttatttcccttccttccttccctcctctctctccttccttccttcctctctctctttctctttttctttgttttctttctctttctttcttcctttcttttccttccttccctcctctctctgtctctctctttctttctttcttttttctttctttccttctttctttctttcgtttttcagggtcttgctctgttgcccaggctgcagtacagtggtgcaatcatggctcactgtagccagaacctccctgacttaagcaattctcctgtcttggcctcccaagtagctgggactacaggcacacatcaccgtgcctggctaattgttttatttttggtagagatggggtcttgctatgttgcccaggctgatcttgaactcctgggctcaagcaatcctcccacctcagcctcccaaagcactgggatttcagcgtgagccaccacacccgaccagttccttctttaaaatgaagatcataatgatccctgcactatagttttattacaagtattacataaaaccacacgtgagaatagaactaacccacttcccggcctggagcaggcccttcattcaggcttattgaatctggacctgctttggccccacccaaaccgatatgccccaggtcctgtttatttatggacagccctcaccctatggagctgatccagtgtttgccccacagcatcataatggcataggcaacaggacagtgtcacatttcacagcagcctttcttccctgttctgaaggagggagccacatggacgttttagtggacagaggagaaacacacacatgctttgtgtcatgacaaggctctgccattgcactggctcaagatcaagggcctaaagtgaggaacaaaaggccaaggcacaccaatgcaatagaacagtaacagcatgtaccgctgactcaggtcctctgcctaccctgggcaatgtctccctcaatctttgcaacacccctatgacatgggtcaaaaagtgctccttttttttttcctgagacggagtctcgctttcttgctcaggctggaatgcagtggcacaatctcagctccgcctcccaagttccagctattctcctgcctcagcctccctagtagctgggactacagacatgcaccaccacgcccagctaattttttttgtattttgagtagagacggggtttcaccatgttggccaaacctgtctcgaactcctgacctcaagtgatccgcccacgtcggcctcccaaagtgctgggattacaggccgtgagccaccgcgcccagcctcagaagtgctccttttttaccaatggagaaacagcccagagaggaaaagcgatttgcacagagtcacgcagctgaagactggcagatccaggctgtttgctgtcagtctgagctctcgaattctaagacgagccacttctctcgggaagccaggaaggctcctcgcaaatcctggtggagaagtggttacctcaaagccctttaagcacagtcataaacttaccttgaagggccaggtaatccgatcatagagtcggcgttcaaaaaaaaaatgaggtattgatatgtttatcctcaccctcataacctgttctattcaaataaattcagtgtgctcagttctgcagggagtgacagagctgccccgaatcagatggtgccacgcacatcccatttctcttgcgggatcattcctggaggagcttcctgcagccaaatgacatcgagtgtgaccatttcaaagtacaaacaggattaaaaggaaaacatctgtaccttactaggctgcactaactcagttacaaacaagctgtgtagatatccaaatgcgcagtgacttttgctgcagaggtgggtggtgaccatctggactgggcattgattagaagataactggacatccgtgtgactgcatccttggtgggggtcagggcacagagatatatgtttgattccacaatgtcagtgtgactcagagacccttttgttgtcgttgtttatattacagttagtgagtcacccactacacctccctcctgggatgaagtcctgagctgtagaatgactccaaacaggcacgactgctttattagcaggctttgactcccatacagggctctgaacatcaaacaaagttggccaggatttgatcctcaaaagagaagatgggatcccatcaagatgtccacatgcctaacgcctgttggtccaaaagagtctcattttgtagggggaagaaacttaattaccagcgcaggaagagactctcagaacatgtggttttcagttttgccaagattccaggccaacttattactctattatcattgttgttaatctttgcttgaaagatgcatgaagtcagtaagtccctttcttaaggacaccaaagctgggagtctctgaaaaacaggaccaaacagtggaccactggtcagaggcacgatgtgagtaaagagtagcagaaatatttttgtcatgtatccacattaaagggtgactataaagtatgttccacaatggctttttttttttaccccctcagcaaagaaatagcactctattttgtttggaaaacctactttgatgcctcaaaaaaataatgtgcttttctgattctgatttttcctcttttctttcagcaactgtgttctgcctgtctctaaaccagtacttggaaggaatgtctctctctctctgtttatatttctatgtttcagagtcaacgtcatggctaaaggagacgtgatttgcaaaaaggcttgttctccaatagccaaggaaaatatgttttttaaaaatcttggtaatgcattagttttggcatctttaaaactcctttttccttttctttttttagggggtaggaggacagggtcttgctctgttgcccagactggagtgcagtggtgcaatcatagctcactgaagccttgctcaagccttcactcctgagctcaagtgattctctttcctcagcctctccaatatgtgagactacaggcatgtgccaccacaaccacctaatttaaaaaaaaaaaatttgtagagatggagttctccctatattgcccaggctggtcttgagctggctcaagcaattctcccgctttagtctcccaaagcgctaggattacaggtgtgagccactgtgccgagacttgtttttctcctctttttgtgatccctcccaaaatttgctgtcaataaactgtgtggtcctgtgagtgacccagggcagagacaagcattgtagccctgtcaccaactggccaaagatggctgctacatgatttcccttatccaatctaaagggggctattggagggggacagagggccatctgtgtccacaaaacgagcccagagttgggactgctgggactatacacatgtgaccgtatgtccagttgagagttgtcatacataaccagacagtggaggagcatggtggtcaacccagaaatgatgagttgggttctagggctgacagactgaaggctttatgaatgaccttttcacttcgttgacacataggtgacccctgtgtcctctaaatggtgcaggccaggcatcttttccgagacctaatggttccttctcttttataaatggccagatcgaagggcattagtgctctcaggcacaataggcctcaaaggcccctgcctccttcctaaatgggccttactgcaaaaccctaatgcacttcctcacactgggacctcagctggctctgtgcacaggcctccctgcagcacaggccctccctgcaaccacagcagtcactaatgaatattttatcagtcgccatgcctctctgtgcaggctgtatctggaagtcatctttgctgatttgacagcctttctgccttaaaggagccaccagcaatgatgtgttgccatctgtttagaaatgaggactcagccagcctcccagttaagctggaaagctgatcctccttagaacagatatttgaaaagagggctttgctctcatgaaagcccacagtctgcccctgcagttcccttgttactaattccagtgggggaaaaaaaattaagaaaatgtagacctagaagatcagaagattgcctcttcaaaaggcactagtttctaagagtagtattcctattattttattttagatcttgggtgaattcatttatttctacaacaaatgtttatctagttcctacttcatcagaaaaaacactggaactcagcccggaacaggaagaagctgactttgccctcggagaacagacagcctagtgaggaattcactgacttgcacattcatttattcaacacctatttacagagtgactatgatgtgcctggcattgctccggggacagggatacacagtgaacaaaacaaacaaaaatcattctgctggaagacaaaatataatcacacaatgtatataattattaaatgcgataagcacaatgacaaacatttccttacaaatgcctttcctgagattctatatccagctaaactatcattcagcagtaaagacaaaaccgagacattttcagatatacaacaaataagagagtttcttatgagcaggtgctcactgtcagaggaaagtgaaaaaagtgaacaaagacgaaagaaacaagaggcagcacaaaaatccaggaaatacattaacaaatgcaatgaatgactgcaatttttgtattttaacagagaaaaaaatgaacattcctgaaaatagtaaaatagaaaaccaagataaaggagaaaggatttttaaaatctgactttttagtcaaacaaagaaagcaaacaagcctctagcaagattgacttttaaagaggggtacaaaggcataaataatagcaggaatagggccaggcaccgtggctcacgcctgtaatcccagcactttgggaggccaaggcaggtggatcacgaaatcaggagtttgaggccagcctgacaaacatggtgaaaccccgtctctactacaaatacaaaaattagccgggcgtggtggtgcgtgcctgtaatcccagctactcaggaggctgagcaggagaatcgcttgaacccgggaggcagaggttgccgtgagccgagaatgcactactgcactccagcctgggtgacagagtgagactctatctcaaaataataataatagcaataataaataaaaacagatgcagttgagtttttttttttttaattaggagaatgcaatgaatacctttatgctaacaaatttgaaaacttagatgaaatgaataattttatagaaaaagactactaaaatggacccacagcctgggcaacatagtgagacccccatctctacaaaaaatcaaaaaagttgctgggtgtggtggtgtaccgctgtgtttgggaggtgtactcaagaggctgaagtgggaagaccgatggggccgaggagttcaaggctgcagtgagctatgatcaccccactgcactccagcctggacaacagaccaagaccctgtttcaaaaaataaaatctcccagcagtttgggaggccaaggcgggtgaatcaccttaggtcaggagtttgagaccagcctggccaacatggtgaaaccctgtctctactaaaaacacaaagaaaattagtcaggcatggtgacacacgcctgtaatcccagctactcgggaggctgaggcaggagaatcacttgaacccaggaggcagagaggttgcagtgagctgagatcagtcagaggttgcagtgagctgagatcatgccattgcactccagcctaggcgacagagcaaaataaaataaaataaaaaatagagccaagaagatcttttaaatatgaaataaatcaacaactattaaagaaattgaactggcaatcaaaagttctcccacaaccactcccacacctcccccacccctcgcccccaccatacacacagacaaaagacagattgttttccaggcaagttacaacaaagctttgaagaatagaaagccctcattttatgaaaacagtttcagagactagaaaaaggggggaaggtattgaaagaacttgataaagttagtataatcaggaagcccaaaccagagcctcatggtgccaccaggagagaaggtcctagcacctttgttctatcagctggggctctgcctgtcacgctggaaacaaaggtttcaattacacagagtaactgtcaggaaaaggcaggttagctgttggctgtctttcacatcaaactatgtgttaaagtggcaactttctttactccgcacagatctcacactagacctagatgaggctgggccagaagcaggaatttcaaagaggagctttaccaaatgcatcctggtttatgtaaatgcaggtgccaataatatcactggaacggtggctcatgcctgcaatctcagcactttaggaggccagggttggggaatggcttaagctcaggagttcgagaccagtctgggcaacatggcgaaacgtcatctccacaaaaaatacaaaaattagcaggacatcatggcccatgccgctcatcccagctactcaagatcctgaggtgggagttttgcttgagcccaagagtttgaggctgcagtgtgtcaagattgcaccactgcaccctagcctgggtgagagagcaagaacttgtctcaaaataataataatcatgtcacttcactaaaaatgagaaatctggagccagatacagtggctcacgcctgtaatcccagcactttgggaggccaaggtgggaggatcacttgaggtcaggtgttcaagatcagcctggccaacatgatgaaaccccatctctactaaaaatacaaaaattagtcaggcgtggtggagggcacctgtaatcccagctactcaggaggctgaggcatgagaatagcttgaacctgggaggtggagtttgcagtgagccgagattgcgccactgcactccagcctgggtgacagagcgagattaagtctcgagaaaaaaaaaaaaatgctgggacaaatgctagacgaaatgggacgccaggacaaccggtaaaagccaggactctgctgagccaaccaggaaatgaaggtaaatctcactctagcaagagagttaatgttctggacgtaaaatcaaaacaccaagtcaaaagcatccctccatagcaatagaaaccacttagaaagtgtaatagaaggaaaacacacatgaaggtattaaaggaaaaacacacacaacagccaccgaaagtatttatggccgggcgcagtggttcacacctgtaatcccagcactttgggagggcaaggcgagtggaccacttgagatcaggagttcaagaccagtctgagcaatatgatgaagccccatctgtactaaaaatacaaaaattagctgggcgtggtggcatgggcctgtaatcccagctactcaggaggcagagacaggagaatggcttgaacccaggagactggggttgcagtgagctgagatcatgccactgcactccagcctgggcgacaagagtgaaattatgtctcaaaaaaaaaaaaaagtatttacaccaactgtgaatgtatctactttaaaagaactttataaagaacagtataaaacatgatcagaaaaaaatatttttaaaagcatccagaaattatatcaagcatacctggtcttgttgtactttgctttattgtgttttgtggatactgcatttttacaaattgaagatttgtggcaaccctgcatgaagcaagtctatttgagtcacttttccaacagcatttgctcactttgtgtcgctgtcacagtttggtaatttccccaatattttgaactttttcattattattatgtgttataataatccatgatcagtgattttttattttttattttttgagatggagtctcactctgtcacccaggctggagtgcagtgccacagtctctgctcactgcaacctccgcatctcgggttcaagtgattctcctgcctcagcctcccaagtagctgggattacaggtgcccaccaccatgcctggctaatttttgtatttttagtagagacagggtttcgccatattggtcaagctggtctcaaactcttgagctcaaatgattcatctgcctcggcctcccaaagtgctgggattacaggtgtgagccactgcatctggcccgatcagggatctttgatgttactattgtaattgttttggggcaccaaaaaccacgcccatatgacagcaaacatactctgtacatgttgttcatgttctgactgccccaccaactggcctttccctgtctctctccctctcattgggcctccctctcccctgagaaacaacaatgttgaaattaggccaattaataaccctacaatggcctctaagtgcgcaagtgaaaggaagagtcacacatctctcactcaaaatgaaaagctagaaatgattgagcttagtgaggaaggtgtgctgaacgccaagacgggctgaaagcttggccccttgcacaaggtagccaagttgtgaatgcaaaggaaaatttccttcctctcttgaaggaaattaaaaatgccgctccagtgaacacaggaatgataagacagggaaacagccttattgctgatatggagaaaatctgagtggcctggatagaagatcaaaccagccacaacattcctttaagacaattcctaacccagagcaaggccctaactgtcttcaattctatgaagatggagaggtgaagaagctgcagaaaaaaaaagctggaagtgagtagaggttggttcatgaggtttaaggaaagaagctgtctccataacataaaagtgcaaggtgccaggcacggtggctcacacctgtaatcccagcactttgggaggttgaggtgggtggatcaagaggtcaggagttcgagatcagcctgaccaacatggtgaaaccctgtctctactaaaaatacaaaaattagccaggtgtggtgacacacgcctgtaatcccagctcctcaggaggctgaggcaggagaactgcttgaacccaggaggcagaagttgcagtgaaccgacatcacaccactgcactccagcctgggcgacagagtgagactctgcctcaaaaaaaaaaaaaaaaaaaaaaaaaaaaaaagtgcaagttgaagcagcagcagatgctgatggagaagctgcagcaagttctcaagaagatctagctagaatcactgattaaagtggttacaccaaccaacagatttgcagtgtagagaaaacagcctttcattgaaagaagatgccatccaggactttcatagctacagaggagaagtcaatgcctggcttcaaagtttcaaaggacaggctggctctcttgttaggggctaatgcagctggggactttaagttgaagtcaatcctgaaaatcctggggtccttaagaatgatgctatatctactctgtctgggctctgtacatggaacagaaaagcctcaaagacagcacatctgtttacagcatttttttttttttctttttgagatggagtctcgctctgtcacccaggctagagtgcagtggtgcaatcccggctcattgcaagctccgcctcctgggttcacgccatcctcctgcctcagcctcccaagtagctgggactacaggcgcccaccaccacgcccagctaattttttgtattttttagtagagacggggtttcaccgtgttatccgggatggtctcaatctcctgacctcgtgatccaccctccttggcctcccaaagtgctgggattacaggcgtgagccactgcgcccagcctacagcatgttttactgaatatgttaaacccgtttttgagaccaattgcttataaaaaaaagatttctttcaaaatattactgctcattgacaatgcaccttgttacctgagagctctaatggagatatacagtaagacgaatgttgttttcatgcctgctaacacaacatccattttgcagcccatggatcaaggtgtaattttgattttcaagtcttattatttaagaaatacattgagtgagaccgtagctgccatagatggtgattcctccaatggatctgggcaaaatcaactgaaaatctggaaaaggttcatgattccatggctattaagtacactcagtattcatgggaagaaattaaaatagcaacattaatggaagtttggaagaagttgattccatccctcattgaggactttaaatggttcaagactttactggagtaagtatttggctggtgcaaaagtaactgctgttttgccattacaagtgcagatccgtggtggaaatagcaagagaactagatacagatgtggtagaaatagcaagagaactagaattgcagatgtggtggaaatagcaaaagaactagaattagaagtggagcctgaagatgtgatggaattgctgcaatctcatgatcaaactttgttacaaaaataattttagacttttattttagattcaggaggtacatgtgcaactgcatgatgctggggtttggggtgtgaatgatcctgtcactcaggtagtaagcatagtacccagtaggtagtttttcagcccttgctgtcctccctctctcccatctctggtagtttcccatgtctgttgtttccatctttatgcccatgtttacccaatgcttagctcccacttataagtgagaacatgcagtgtttggctttctgttcctgtacaatttgcttaggataatgactttcagctgcatccatgttgctgcaaaggacataatttcatttttttatggctgggtagtattccatggtgtagatgcaccacgttttctttatccaatctgccattgatgggcacctaggttgactccatgtctttgctattgcaaatagtgctgcagtgaacatacaagtgtgtgtgtctttttggtaaaatgatttattttcctttgggtttatatccagtaaagagattactaagttgaatggtagctcgttttaagttctttaagaaatctcgtaactgcttttcacagtggctgaactaattcacatgcccaccaacaatgtataaagcgttctctcttctgtgcagcctcaccagcatctgttattttttgactttttagtaatagccattctgactggtgtgagatggtatctcattgtgattttgatttgcatttatctgatggtcagtgacgttaagcattttttcatgtttgttggccgtttgtatgtcttcttttgagaagtgtctgttggccaggtgtggtggctcacacctgtaatcccagcactttgggaggccaagtcaggaggatcacttgagccttgaaccttgaggagtttgagaccaaccggggcaacatagggagaccttgcctttacaaaaaatgaaaaattagccaggtgtggtggtgcactcctgtgatccgagctacttacgagacaggtgggaggatcgcttgagcccaggaggttgaggctgcagtgagccgtgattgcaccactgcactccagcctgagcaagagagtgagacccagtctaacaagaaatacccaaaaagtgtctgttcacatcctttgcccacttttcaatggtgttgtttgtttttgcttgttgaaattgtttaaatttcctacaaattctggatgctacacctttgttggatgcattagtggatgaagagttgttccctatggatgagcaaagaaagtgatttcttaaaatggaacctactcctgatgaagacattgttgtaggagctaagaagagagttctccttggctctgtgatggttcactgaaaaaatcacctctcaaaaggcagattaactggagaaaagacatgcacatttattttaattgtatacaaggaaacttttagaatgaagacctaaagatacagggaaaattgtctgttttcttttcttttttctttttttgagacagagtctcactcttatcacccaggctggagtgcaatggcatgatcttggctcactgcaacctccacctcccgggttcaagtgattctcctgcctcagcctcctgagtagctgggattataggcgtctgccaccgtgcccggctaactttagagacaggatttcaccatgttggccaggctggtctcgaactcctaacctcaggtgatccacccaccttggcctcccaaagtgctgcgattacaggtgtgagccagcgcacctggcgtccattttcatgcttacattcaacaaagtatgcacagccatgtagaaacatgattggacaaaaagtgtgtgatctaatggtaatagacttagtggagaaagccagcgagacctatctgtctagattcttctaggcctctctgagagtgaattccttagggggcaggacactttctggaatgggactcttacgacctacagtctaaaaaggtagatcagataatttctttatctgatccacctttttttacacagatagggcagagggaaagttaagtaatctttttctggttttatggctggcttgggggaaaaaggggttctggtttctatgacctgctttggggaagagggattctagtttttgtggtgcctctggggagaatgggactaaaagacaggcaggagggcagagaaaaaccttttgcttctgaggccctcatcttggagtattgttttctgagtcccaacactgtaaactttgttgaaatgacaacagaggatttattaatagcacagtatcatgaataaactcaacataaacttagttgataaagcagcagcagagtttgagaggattggctccaattttgaaagaagttcgacaatgggtaaaacactatcaaacagcaccatatgctacgcagtaattttttgtgaaaggaagagtccatcaaggcagcaaacttcattgcggtcttattttaataaattgccacagccagcccagccttcagcaaccaccaccctgctcagtcagcagccatcaacatcgaagccagactctccaccagcaaagagattatgacttgattaaggctcggatgatcattagcaccttttagcaacaaagtttttgtttgtttgtttgtttagatggagtctcactctgtcacccaggctggagtgcagtggcatgatcttggctcactgcagcctccaccacccaggtgcaagcaattctcctgcctcagcctcccgagtagctggcactacagatgcacgtcaccatgcccagataattttttttatttttagtagagatgtggttttaccatgttggccaggctggccttgaactcctgacctcaagtaatccacctgcctcagcctcccaaagtgctgggattacaggcatgaaccaccatactgggccaacaaaatattttttaattaagacatgttcactggttttttaaatatacatatatatatattctaaaattctattgtgcacttaatagactataatatagggtaaacaaattttgtctgcactgggaaaccaaaacatttgcatgacttgttttattgaggtggcctggaactgaacctatgatatctctgaggtatgcctgtacgagcttgggaatccttaatataataaattctcttccaacataatatgatataatctataattatacataataatataataattatagtagtaggatagactaattctctccaattaatttataaattgaattcaatcccaagatggtttatcaaggaactttcaaagcttattaaaaatgttatatgtgctttggaaggccaaggccagaggactgttggaactcaaagttcaagactagcctgggcaacatagcaagacctgtcactattcaattaaataacaataaaaaaagagtctgggcacagtggctcacacctgttatcccagaattttggaggccgaggtgggcagatctcttgagcccaggagtttgagaccagcctgggcaacatggcgaaaccccatctctactaaaatacaaaaattagccaggcacggtggcatgcacctgtagtcccagctacttgggaggctgaggtgcaaggatcacttaatcccaggagttggaggccagcctaggcaacatagcaagatcccttctctacaaaagagtaaaaaaaaaattacctgggcatggtggtgtgggactgtggtcccagctacttgggaggctgaggtgggaggatcacttgagcttgagtggcagaggctgcagtgagttatgattatgccactgcactaaagcctgggcaacagagtgaagccctgtctggaaaaaaaaaaaatggataagactcagaaatagccaagtggaagaggtgccgagggtggggtatggggagcggcgtggagcttccagccctcttctaggcccaccatcctcccagcacctccatgtgtccatctacccagaagctctctgaacatcatcctttagggtttttatggaggtcccattacatgtgcatgataggtaaatctttggctatcgatgattagctcaatctccagtccctctcccctctcaaggtgagtggggggctgggggagtgaggctgaaagttcccaccctctaatcacagggttggctcttctgacgaccagcccccatcctgaagctatctaggggcccaccaagagtcaccttattagcatgaactcaggtatggttgaaagaagtttgtcataaataacgaaagaagctccactaccgctatcactcaggaaattgcaaggattttagaagctctgtgtcaggaaccataggaagaccaaatatatatttcttactgtgtcaccatgcgctgtaggagctcctacacagcttcatagtaacacaggtccaagaaagtccattgcattattgtttctaataattcccaaatgctctgtcagtaatgataacataatgttcagctgctagtgatggaagtgtatctctagaaaggtttattctctcaagttaaaaaaaaaagttgaggcctggtgcagtggctcacgcctgtaatcccacccctttgggagcccaaggcaggtggattgagatcaggagttcgagaccagcctggccaacatggtgaaaccccatctctactaaaaatacaaaaattagctgggtgtgttggtgggtgcctgtaatcccagctactcaggaggctgaggcagggaattgcttgaacccagcaggtggaggttgcagtgagccaagatcacaccactgcactccagcctgggcaacaaagtgagactccgtctcaaaaaaataaataaaatcaatcaatcaatcaatcaatcaatcaatccaaggctgggatgaaggctccacaaagtcaccagggacctggtttccttctgtcttcctgctctgtcgtactgaggagggaggcttcatcctcagcatcactgcatggtctaatgtggctgctggagctccagctatcaaatccacattccaatcaacagaagagggcgagggagggaggaagagcaaaagcgaatgccccagtctgtccctctttggagaagcgctctcatatatcctcccctgaaagttctgtttatattgtggtgaccagaatatatgtgtagccacacctggaagcaaaagaggtaaagaaatgtaggcttttagctgggcacattgttgctttgcgtatctgttactaaaggagggaaaaagtatttgggaagcaaccagtagtctttgtcactcaacttaaatatctttaggagaatggataaataaattacagtgtatttgtgcgatggagcactatatagtagttaaaatgaaggaaatagagctacgtgaatccacatggataattctcagaacaaaatctcttgcccgaaaaagcgagttgctgagttccaactctacgatgccattcatataaagtttaaaagcctgcaaaacaacacaatgtatctttgatggctacataaaatatatatgttgggaaggtataaaaacataaatgaaaatgaaaaatactaaacgcaagatgatggttacctctggagagggagagcaaacagtgtgatcagaaacagagacatccaggctttcgattactacctgtgatgttgtatttctttaaaagacaagaaaaaatttggaggaaacagcaaaatgttaaggcttgtaaaagtcgaattgtgagtacgcagcatttaacccaccattccctatatgtttctgtatgttccacatttgtcattgtatatgagctagataaagaaggagatcaagatcatctagaggcataacttaatgagatgtaacccacatatggcgaattcccacctctcaaggatacagcatgatgaatctttacagagtgaattcctccagagaagggtatagaatctagcatcccagaaatttcctctcagtggcagccccagcaaagaaaaaacactattgtgatatctaccaccattgattgtatggtttttttgttttgttttgagacagtcttgctctgtcttgcccaggctgcagtgcagtggtgcaatcacagctcactgcagctttgaactcctgggctcaagtgaccctccggcctcagcctcccaggtagctgggtctacaggcgtgtgccgtgacacctagctaatctcttttatttttttgcagagatggggtctcactattgtgaaacccaaaagtctgagacaggtctcagtccatttaggaagtttgttttgccaaagttaaggatgcgagcccatgacacggcctcaggaggtcctggtaacatgtgcccaaggtggtcagaccacagcttggttttatacattttagggagatgtgagacatcaatcaacaaatgtaggatgaacattggttcagtccagaaaaggccagatgactcaaagtagggagggggcttccaggtacaattggttgtattctactgagtttcagatgagcctctccaaaggaggcattcagatacgcattcatctcagtgaacagaggaatgacattgagtcgaatgggaggcaggtttgccctaagcagttcccagcttgactttttcctttagcttagtgatttgggggccccaagatttattttcctttcacgttgtgtttcccagacttgtctggatctcctgaccttaaacctccctcccttcttaacctcctaaagtgctgggattacaggcatgagccagcatgcatggcctgcgttttgtcttttgcaagaaggaattgtcagacgtgtgtgaatgaaagcaactccatcttaaataggagctgggtaaaatgaggctgagaccaactgggctgcattcctagatggttaaggcattctaagtcacaggatgagataggaggtcagcacaaaatatgggccataaataccttgctgataaagcagcttgcagtgacggagccggccaaaacccaccaaaaccaaagtggccacgagagtgacctctggccgtcctcactgctacactcccaccagcaccgggacagtttacaaatgccatggcaacgtcaggatgctgccctgtatggtctaaaagggggaggcatgaataatccaccccttgtttagaatatcatccagaaataaccataaaaatgggcaaccagcagccctcggggctgctccgtctatggagcagccgttctttattcctttactttcttaataaacttgctttcactttgcactacggactagccctgaattctttcttgcgcgagatccgagaaccctctcttggggtctggatctggacccctttcctgtaacatatttacggcgatcacaaagggattaaagtgcagaaaccctacagaatcacgccaaatcatacggtatattctcgtgaatggctgacttcattttctcagcagtatgtctctggagttcctccgaagaagccgttttctaatcttcagcactcatccaatcagaaggctggagctctgcgctcgacataaggaagaacttcatcattaactccccgagccctgcaaagcagctgggagggagatctaagtttttggagtggatttcaggatcctttgtacccacagctgtttagggagccggcgtcctgctgacagctgtaggtggatttgaaaatgttcccaaattccctcctggccctcagtttcccatttctcttcctctcctgatgtcggctctaaataaagaaaaaaccaagtgtcaggggctgcagagaggctcctgagaatgctcacatctcagctctcagacagctcacaaggggtgttaaaataattaaagctgaaaagggagatgtaggtattatttttagacaagcgtctaaggtttacctgttatacgtgcccttcattcctgtccctcattcactgccagcatctttttttttttcattaaatagaacaaaaatacacttaaattttatggcatggctaataaaaaaaaaggttaagttgaactcatttcatcaaagatttgtggtgggatgacccactgtagttttgttgatgtgtttgcttttttaacagactttattttttagggtggttttaggtttacagcaaaattgagcagaaggtacagagaattcccatatactgtctgcctctccaacacacacacagcctcccacgctatcaacattcctgccatcgtggcacatttgtaatggaaaccaagagtctctgagacaagtctcaatcaatttagaaagtttattttgcccaggttaaggacatacccatgacccagcctcaggaggtcctgatgacatgtgctcaacctggtcagggtacaattggtttatacatcataggcagacatgagacatcagtcaatacaggcaagatatgcaatggttcaggatgcgaaggtgagacaacttggaaacaggggcgtccaggtcataggtagatttaaaatttttctgattggcaattggttgaaagagttattatccgtagaaaggaatgtctgggttatgataaagggttgtggagaccaaggttttgttttgttttgttttgttttttgagatggagtctcgctgtgttgccaggctggagtgcaatggcacgatctcagctcactgcaacctccacctcctgggttcaagcgattctcctgcctcagcctcccaagttgctgggatgacaggtgcgtgacagcacgcccagttaatttttgtatttttagtagagacagggtttcaccatgatggccaggatggtctcgatctcttgactttgtgatccgcccgcctcggccttccaaagtgctgggattacaggcctgagccactgcacctggcccagatcaatgttttatcctgcaaatgaagcctgtagatatcaggctttagagagaatagattgtaaatgtttcttgtcagacttaaagagtctgttttatcagcaattccaaaagggaggaggggataatgaggcatgtctggctttctctttccaacatggcctgaactagttttttcaggttagctttggaatgctcttggccaagaggaggggtccatttagatggctggaggacttagaattttatttttggtttacagaaaaaattgatgaaccttacactgtacatcatcatcacccagagtccagagtttacattagggttcactcttggttgtggtgtgttttctctgggtttggacaaatgtctaatgacattgtaggatcatacagagaggtttcactaccctaaaaatcctgtgtgctccctgccagcattttttaacatcatctctttcaagttgtttttgtcaaaaatgttaaattaccaaacaatgcggcgatatgttcttgcaaaagtaaaggctacagatacgtgctgatgggttctctccactggtctggaagcatgcagcacttacaaagcgtcctgacatgggatctgtttcctgcgtgtgcagtggttggtgggttacactctacctgtctgcttccccatgtgtgggaactacaaggtgggccacagttcctggtcagccaccacacctagccaaagacttccagagactgctcacaggtccctggaatccatccgtgaaattgtcagaggcatttgaaccagagcacctccatcttgaagaggaactgggtaaaatgcggctgagacctactgggctgcattcccagatggttaggcattctaagtcacaggatgaggcaggaggtcagcacaagatacaggacataaagaccttgctgataaaatatgttgcagtaaagaagccaggcaaatcccaccaaaaccaagatggcaacaagagtgacctctggtcattctcactgctacactctcccaccagcatcatgagtgtttacaaatgccatggtaacgtcaggaagttcccctatacgatctaaaaacgagaggcttgaatagtccaccccttgtttagcatatcttccagaaataaccataaaaatgggcaaccagctgcccttggggctgctctgtctatggagcagccgttctttattcctttactttcttaataaatttgctttcactttacgggctcatcctgaattaatgaattaattctttctttcttcttcttcttcttctttttttttttttttttttttttttttttttttttttatggagtctagctctgtcgcccaggctagagcttggcttactgcaacctctgcctcctgggttcaagggattctgctgcctcagcctcctgagtagctgggattacaggtgcaggccaccatgactagctaatttttgtttttttttttgtttgtttgtttgtttttttagtatagacagggtttcaccatgttggccagcctggtcttgaactcctgaactcaggtgatccacctgtctcggcctcccaaagtgctgtgatgacaggcgtgattacaggcgtgagccaccgtgcctggcccacctggctaatttttgtatttttagtagagatggggtttcaccatgttggtcaggctggtctcgaactcctgacctcaagtgatcctcggcctcccaaccaggtccaagaaccgtctctgggggtcttgatcaggacccctttcctgtaatatctttctggtgtccacagaagggactatactgcagaaacacccaacccaaaggctaattttgggtaagtggtgggatccagtaacaaaattaatggaccgacggaagtccaatccaaactacaaaagtaacagagacttgtataaaacacatgcacacacagaaacacacactgcacggagccccacagagaattccatttttgaattattcatttttcacttccatattgtcattgttttatctgcagtggagggagaattccctgttgctggtgaagttcatcagagtcttatatgctatgatcggtgggagggtggatcacaaaatatgacagtctgaatttgactgccagatctatttgcccacgcatttaaaccccattcccaacttagctaaagaaattatctcataatagttttgtttttgcattgtgcaaaaggacagcactaattatccaggtaactcagggcctcctgaagctcagaaaacattcctggaaagaacacaatgaatagtcacctctgcgagaggggaatgcagagagctgcgatgctgactgggagaaaagaggaaatgctgcttgccttagtgaagccgattcaatctctgtgcaagggagatactgagcttatttcaacaaagaagcaaaaatgagattgagttcattccccattctgtgtaacccaaactgcattcaaggatagtgtctatttgcttgtaattcctctttgacttgagaaggaagaatcatgactctggagaaaggaagaatggaagagaagcaaggtgctgattagatgctggctgaattatggagagtctgtccagaagaggggggagttggtgtacttgaagattcagccaaggagaacagtggaaaccaataaattatttttggcttctgagaataaggacctgttggtggaaaaggttgggaatggagtacctgggaagggagggaagggagtgttgtccgatttcgatgcaatgccagcatctctaaacttgtaagagacagcaggcacagtggccaggactcagttcctctgtctgcagctccctggggccacacaatgcagtccagcttttgcctttgccacctggagttaggagagaaaagcttcgtgttaaaacttgaggcactcgaacgtttatcaaatctgagatctgcaagtgtgtgcctgcaccagggattagcaaacaacaaaatgccattaaaagctaaaaacaacaacaacaactctctttgcagcatgtaggtgcctttgcaaagttctctctaagccaaagttcgtggacttccaatcttgtcaaaatcactactaattaataccttttcacttcccactgaaagaaaaacaattcaccattaagtcaggcagcctacccataatcactctaacaccttctatgtatgttttgaaacgtgctctcacatttcatgatccgtttattttacaagatgggtaaactgcagacaattatggtgataatacggctgaggtgtttggtttttatctgttcgcagtaaattgtggttgttcaagccttctcagtaatgatttccatccctctctcaatctcttcctatcacctggcgataaatagaatgtttttaaaaaagaatgttagtttactatcatcattatcacctattcaactagcaatataattaaataatttcttggtaggtatgactcaattaaattaattacactaacagatattccatggtacacgcctctaaaaatataaagcgtattcactgttgtgtgtcatttttctctgtataggcaggaagagctatctggataattgagcaggcaattttgcttttgaaagatgctatcaaagtacgcaaggatttaatttcagattttttattagaagacagtgccttctgcatgtaattctccgcggctgatgcatttcagaggttcatgagcagcggacacgaagataaaaactgaaagccagggctatgggaatagctggaccatcagtggagtcttggcatcttagacctggtctcttgactgcctgttccttctgaaatgtccttaggccactttggccagaggcattctcggacttatgaaaaggggaacctgtaggctgtttgttgaggtctaaaaggattaagatttgaaggtgacacccctgttgggataatctccctcaaaactcttctctaaacaactgaagataatatccttataccttttgcctgtggttctctccaggggatggtctcaaagtgttcttgaaaatgtgtttgaagaaaataggcaatgtattagtgtgatttaaagattccctcccaaaattttcacttccacggggctcagcgggaaaatagggtaatgtagagtgagcctctctccctggtgacataggtggcctcctattaattaggttagggaaatgcagaactaacttgccatttggagaaagtcacatgaaatagacttctttttttccgcctccagaattttgaattcattgaacatggccacagcaagagtcattctttacaatcctctgacatttgaaagtaagaagctttagactttattctaacgctcttttaccttcttcccggtccctgacaactgtcacaccaggtccacagagacagccacaactctaaaagggtcagttatatggtaataatgacagctaagctccgccagtagcactctaaattttgcaaagtggctttgcaaatattagctcatttgtttatgaacccaagatccctagcacttagcaggggtggtggtgggggtgtgagtgggaagtgtgttggatttcatttatcttttaaaatcctaactgggctcagtgtggtggctcatgcctgtaatcccaatgctttgggaggtggaggtgggaacatcacttgaggtcaggagttcgagaccagcctggccaatatggtgaaaccctgtgtctactacaaatacaaaaattagccaagtgtgatggcacacccttgtaatcccagctactcaggaggcagaggcacgacaattgcttgaacctgggaggcagaggctgcagtgagccaagactggacccctccactccagcctgggcaacatagcaagactctgtctctacaaaatataaaattagccaagcatcgagggggtcttagcatcttagacctgggattagtggtgcacgcccatagtcccagctacttgggaggctgagacaggaggattgcttgaattcaggagttcaaggctgcattgagctatgatctcaccactgaactcaagcctgggcaacacagtgagaccctgtctcaaaaaaaaaaaaaactaataaataaaaaataaaaatagggctgggctcagtggctcatgtctataatcttaccactttgggaggccacaacaggaggattgcttgagcccaggagttcaagaccagcctgggcaacatggtgagatcttgtctctactaaaaataaaaaatgagccaggtgtgatggtgcacacctgtggtcccagctacttcggaggctgaggtgggaggattgcttgaccgcaggaagtcaaagctgcagtgagccatgtcacaccactgcactccagcctggatgacagcacaaaaccccgtctcaaaaaaaaaaaaaaaaaaaaaaaaaaaaaatatatatatatatatatatatatatatggccaggcacagtggctcacacgtgtaatcccggcactttgggtgactgaggcaggcttatgacttgaggtcaggagcttgagaccagcctggccaacatggtgaaaccccgtatctactgaaaatacaaaaattagcctggcatgatagtatatgcctgtaatcccagctactcaggaggctgaggcaggagaatcgcttgaacctgaggggcagaggttgcagtgagccaagattgcaccactgcactccagcctgggtgacagagcaagactccatctcaacaaaataaaataaaattaacgaatttaattaaataaataactaatttaaaaacaagatcaaccataataggaatcaaagcaaagggaaatctacccattcttctttgtagaatgttctctgcctgtctctctctctctgcattaatttcaaatctgtattgagttccacgggctctggacagattttatttgggtgctatgctttggggccaatgtgctctctgtagtggtgctgaaggtctgttgcaggtaaccacgtcctgcctcttttgcgatcacccactctgaaatgtgatctagctcccttcttctcccatccttattactgatggaacagatttatcactgtgaggccagcacagctgtttcgtgactcacgggaatatcatatttagcatgtgttccctagtgaatgtatttatttagatgacacataatattgttgaaaagccaagtctgcattgctcttaaacccagccttatggatgaacgcggaggagtgcaaaaggcagaatgagctcatttgggagaggcagctggtcagagagtccttttgggtcattcatgcaatgagctcacactagaaatctaaacaacagggaaatcgaccctgggtgctgaactacagggcacaagaataggaagcagccttataaagcagctcatcctaagcatttgtggctcacaaacattgccactaagcatgggggaccgttgatggcacaccagccttctaaagagaaaaccacagtcatctaccacttgagttgatagagtagcatcttgggaattgatagcagcattatggcttttatcctctcttgaggtcatcctctggaaggtaacaaggccattagcactgaacaagccagatggcccacttagctgacagcgggctcccctcttaacgccctaccccccacccccaattcatcttcccagtcttggtgttgctgtgcctcactgagcgagggctcagaacatctccccaaacacagggtattggagggaaggtgtgctaatgaagttaatgtgtgaaaacatgagcaaccttccggctgggcgtgatggctcacgcctgtaatcccagcactttgggaggccgaggcaggcagatcacttgaaagtcaggggttcgagaccagcctggccaacatggtgaaacccgtgtgtctactaaaaatataaaaattagccgggcgtggtggcacatgcctgtgatcccagctactcgggaggctgaggtgagagaattgctggaacctggaaggcggaggttgcagcgagccgagattgtgccattgcacttcagcctggacgacagagcagcactccgtttcaaaaaagaaaagagccaccttcccattatgtttttaatatccttcttggtgatgtctggagcccgtgactctgccgagacagcgtgctcagggccagtctccaagagctcccattttcttaaacacatcgccttgaacttactcacatttgatctcatctccctccttccttcccactgatacagagtcttcagatctttctgttttcctgtcatcctttgcccaaccctcatcctttcatctgcaaacccagagctttctctgctccccccagtcccacctcttccagctcttgtaaaagaatattaaataaaaccagggctggcactgatctttcagaaatcttactcttgacacatccctatcaaaaaaagtctctgtcccttcatccctggcatttattttttgctctttagtattctctgattgtgtcactgtagctcccatttcaatcaattggtagttcaattatctccaaattcctcgaagtcatgaaagttcaagtaggtatttttcaaacttttttgcagcagtgaaaccctgttaccctgctgttgtgctaccactagacatccagaagagtgtgaatttgtagattaagaccagaaaaagtactcgagcatcttgtagctgattgtgaatatcagcccagggaatgtgcaacacagaaaacagccctttcaggctgggcatgctgttgcacacctgtagtcccagctacttgggaatctgaggtgggaggatcacttgagcccaagaggtcgaggctagagtgagccatgattgtgccactgcactccagcctgggccacagagtgagaccctgaaagaaagaaagaaagagagagagagagagagaaggaaggaaggaaggaaggaaggaaggaacgaaggaaggaacgaaggaaggaaagaagacaaaaaaggaaagaaaagaaaaaaaaaggaaagaaaagaaaagaaaaaaaaaaaaagccccttcctcctcaggtcgtctttgaggctttgcagaaatggcctcagatataggatatagaggaccctatcttccccaggctgcccttcatcttcccttttctacccactcccaaaccagggtcttgaccaccaacttctgatttcctgcacagtcaaagtcagggaaactgactttttcctgacaaagtcaggaaaccatatatatatatacattttgtattttttgagatggggttttgtgctgtcacccagtgatcatggttcactacagctttgacctcctgggctcaagcaatcctcccacctcagcctttctttgttctattctggagagcaagggagattgccacaaatttctgtgggtgtagtggtagtgatggtggtggtgatggtgatattgtggtggtggtggtgatgatgatggtgaagatgatgatggttaagataatgatggcaatgatgttggtggtgatgatgataatgaagatgatgatggtgatgatgatggtggtgataaggatagtggtggtgaggatgatgatattcatgatgatgatatttgtgttggtggtgatgatgatgatggtaaagataatgatggcaatgatgttggtgatgataatgaagatgatgatggtgatgatgatgtggagataatgatggtggtggtgaggatgatgatgttcatgatgatcatactgatggtggtggtaatgatgatgatagtggtggtgaggaagataatgaagatgattatgatggtggtgataatgatgatgatgataatggtggtggtgatgatggtagtggttgtggcgacaataaaatagtgatgatggttgtgatcataatggtaaagatgatggtgataatgatgatggtggtggtaatgataatgatgatgatgatgctggtgtatgtattagacagggttctctatagggacagaactaatagaatatatatatatgggagtatataagtactctttaatatatatattaaggagtattgactcacacaatcacaaggtcccacaataggctgtctgcaagctgaggagcaaggaagccaggctgagtctcaaagctaaagaacttggagtctgatgttcaaaggcaggaagcatcctgcatgggagaaagatttaggctaggaggctaagccagtctagtcttttgacattttttctgccttttattctggccttgctggcagctgattagattgggcccacccagattgagggtgtatctgcctttcccagtccactgactcaacatcctcacagacacacccaggaacaatactttgcatccttcaatccaatcaagttgactctcaatattatctatcacggtggtgataatgatgaagatgataaaggtggtggtggtgatgaagatgatggtagtagtggtagtgatgatgatggttggggtgatgatgaagatgatagtgatggtgaagatcatggtggtagtgctggtgatagtggttgtggtgatgatggtgatgataatgaagatgatgatgatggtgataatgatggtgatgatgatgataatcatggtggtgatgatggtggtggtggtggtggtggtgaagatgatggtggccgtgctggtaatggtggtggtgatgatgtagttgtgataatgatgatgacagcagcagttaacagtgtaaggcatcatttgtagtggtttgcatgtattagctcaggaagtccttatcagccaagtattattaggatgatctaccccattctacagatgaagaaactgagccatagaaccattaaataactcccttaagatgacacagctagtaaaggcggaactaggacttagacccaggcagtctagctctaaagcccacactcccagccactcactaatggtgcaagtggtttagagtctttggggtggtaaatctagaagcaaatgaacttgtattgcatttaagtagaaccatcattaattatgttaaatgacctccacaagcagtaaggatggaatggaaggtgaggggacagagaatcccaccatgatatactttttcacaaaaggaatctttttttttttttttttttgagatggtttctcactctgtcacccaggctggagtgcagtggcgcgatctcggctcactgcaacctctgcctcccgagttcaagcaattctcctgccttagcctcctgagtagcttggattacaggtgcacgccaccatgcccggctaatttttttgtgtattttcagtagagattgggtttcaccatgctggccaggctggtctcgaactactgacctcgagtgatccacccgcctcagcctcccaaagtgctgggatgtcaggtgtgagccaccgtgcctggccgaaatcttatgaagaaaataattacaagtagaactgtttgaggggaaacaggtaagggggctggacccttgtttcctgatctctccaatgaccctctgcagaggccccaaaggctctgcttccagagaccccagggctctatagaattcagctatactactcatcagttcagatatggtagataatccttgctctcacttatgaccctcctgctaggtacttttcttatcagttttaatcctcagaactgcctttggagtgaggtgtgattatcctaattttacaggtgaggagaatgaagctcaggcaaggtttgcaaccagaccaagttcacaaagtgtaagttggtggcagagctgggatttgagccaggacagtatgactcagaaaatgtactgttttccagataaattggctgcttgctgtacatctcccatgtagaaattagatccatcagttttcctttgtacacacactgactcaccctcttgggccttggaagactctagcacagccatcaagtatgatttctctgggcagcacctgcgtggcagctctttctcccactctccattcattccctgccctgtaggttatttttaagtccacaggcttctctcttttatttcaactgccaccagcttggtccagatggtggctgagagctgactcatctgcgctgtaattccccaggcccctctgagccactcttatggccagggtcacatctgtgagctgacatcctctccactatagtggccttctgggctgacagttcccacattcctgccaatcaaccatcccagtttcatccatgagctcctgcagctctctcaggtggatgccatctgcttgcagtgattgatctgcacttcattctttccaatctggcttagaacatcctggtattgaccacggtgtgatctagtacctgtctgtgtagaggctattcaaatagcctctgtagacccaggctagaagtccattcaatccattaactgttttctttttattctttcctctgcagggaacatctattagttacaccatcctttccaaaaatggagtgagcaactgagttggtggtttgtgctctccttgcaggatactgaccttatactgtgatcagcaggttgtgttgcttagtgaatgagagtatcggcattagagtcaggctgacaagagctgaagtgctgtctccatcacttcccacctgtgaagcttgtctggccagtaccactttgtctctctttggggaaatgatctcctccacacgccatcatggtagttgcactggagatcaccaatcacagtacacatcctccttggccacagaaattagcccagggatgggtcactagaagcttccctgaaatgtttctaactggagcccatgggggatgctgtttctgatcatatggacaattccagagctactcctgacccttttctcagttttccaatggagagacatgtttgaagcacataagaatgatgccaataagcacagagaatgagaagcaagagataggggggaagagagacatagggcatgattaggagagtgtcatcccgagaactcagcatctgtggtctcccaaatcagctctatcccttgcctttccaggcatatgagccaataattctttttcttttttttttttttttttttttttttttgcctgagctagtgtgagttgaggtcctgtagattgcagccaatgtccagatcaatgcaacctcacgatgagtttcttgctgagtctctagaagtctttcctcttcaatatcactgaaaggtcttttctcatgcaattggtttgagaatctcttgcaagctacacaacaaagtcttggccaattatgtctggctttgcctcaaaggattctctacttctgtttgaacaacttgtctttttttttttctttcagtgatctaaactatttacaaagcactttcacaccctgtgcctcagtaagtgctgccaaccaccctttgagacaggaatctgttcattcagtcaacagcctttctagtgctaccactgtttttggcactgagaatatactggtgaattagacaaagctcccacttcataagcttacatttcagtgggcgagacaaacaagtgagtaaatacataaataatataacttctagaggcagtaagtcctctgagaacaaatggcgtggggaggttgggtgccattttagacaagatgaacacaaaaggtgataggtagtcataagtgattgtaaggtgtattagtctgttctcatgctgctaataaagacatacctgagactgggtaatttataaagaaaatgaagtttaatggaggctgggtatggtggctcacacctgtaatcccagcacgttgggaggccgaggtcggcagatcacctgaggtcgggagttcgagaccagcctgatcaacacggagaaaccctgtctctactaaaaatggaaaattagccaggcgtggtggtgcatgcctgtaatcctagctactcgggaggctgaggcaggagaattgcttgaacctgggaggcagaggttgcagtgagctgagactacgccattgtactccagcctgggcaacaagagcaaaaactccagcaaaaaaattaaaaaacaaaagagatttaatggactcacagttccactttgctgaggaggcctcacaatcatggtggaaggcaaaaggcacgtcttacatggtggcagacaagagggaatttttgtggggaaactcccccttataaaaccatcagatctcatgagacttattcactatcaggagaagagcacaggaaagactcacccccaagattcaactgcctcccaccaggtccttcccaggacctgtgggagctacagttcaagatgagattcgggtggagacacagccaaatcatatcgggaaagggttcatagaaggccttccttttttccttgcttccttctttccttcttaaaaatttttaaatgttttttggagacagggtctcactctgtgtcccaggctggagtgcagtggcacaatcatggctcactgcagcctcaacctcccagactcaagcaatcttcccacctcagcctcccaagtagctgggactacaggcatgcaccaccatgcccaacacatttttaaatttttgtagagacggggtctacctatgttgtccaggctggtcttgaactcctgggctcaagtgattgtcctgccttggcctcccgacgtgctgggattctaagtgtgagccactaagcctggcagaaggcctttctgaagaattgactttcaatcagagatctacacagagtcagggagtaagcccatgaagagtattccagggagatgctacaacaagtccaaaggccctgaagcaggaaagagattggcgtgatctaagaaagcaaggccagctggatggcgtgaacgtgaggagtgagtctaggcagcttttagcccatatggtacaattacgtttgttagaaaaaggtgccctttctgggtagactaattaccactgacatcattgttcaggacacacctggacaactgtaccagttaattgtggagacagacttaggagacaaggtcagagaaggacgggagccagaacattggattttactctaagctgatgctgcctgagaagaacagaacatgatgttctgtatgtaacttaaacttttccaaaagccacattgtgaaaaaaacaaaaagaaagaggtaaggttgggcgcagtggctcatgcctgtaatcctagcactttgggaggccaaggcagaaggattgcttaagtttaggagttcaagaccagcttgggcaacatagtgagacctcctctctactaaaaatttaaaaaattgtcctggtgtagtagggcacactcgtaatcccagcacttttgggggccaaggcaggaggattgcttgagcccgggagttcaagaccagcctgggcaatgtagtgagactccatctgtaataaaattttaaaaattagccagtttcggtgggccatgccttagttccaggtgaggtatgaagattgcttgagcccaagagtttgaggctgcagtgagctatgaacgtgccactgccctccatctagcctgggtgacagagcaagccccgtctcaggaaaaaaaaaaaaaaaaaaagaagaagaagaagaagaagaaaaacaagaggtaaaataatttaaataatatgttgtttagccagtatatctaaaatgttaacatttcaacatgtgatcaatgtaaaaaaattacgagatatatttaactattttaaaaataaaatttcttcaaaatctggtgcatacttttatacttacagaacttctcaactaaaaataaaaataaaggaaaaaaagaaaacttcctaactcaggtattaaattttttttttttttttgagatgaagtcttgctccgttgcgcaggctggagtgcagtggcgcgatctcggctcactgcaatctctgcctcccaggttcacgccattctcctgcctcagcctccagagtagctgggactacaggcgcccgccaccacacccagctaattttctgtatttttagtagagacagggtttcactgtgttagccaggatggtctcgatctcctgacctcttgatccgcccgccttggcctcccaaagtgctgggattacaggcttgagccaccaaggccggcctaaatttttatcagaaatgcttaagcaatatttggatttcttaagtttatggtgaaaagtagattcacatacccaggttgttccaattgtacttaaacagtttcaaataataaaactggacaccaatttttaaatttaaattaattaaaaataaaactgacttaaatatttcctcaattgcaccaagccacattgctttttttctttatttcttcatatgtcttgtaataattcattattttcagattgatgacaatttttcatgattgttatacgtgaattggaagtatttgtcaaattttaaggtgacaacattgacattcttgttttcattctgctttgatgagtctgtatagaacttgctttttgttttttgtttttaaatttcaactattattctagatatggggggtacacgtgcaggtttgtacatgggtatattgcacccaggtagtgagcatagtacccaatggtagtttttcaatgcccccgcatccttcctcttctttctagtagtccacagtgcctactgttcccatctttatgtccatgagtggtcaatgtttggctcccatttatatgtgataataagcagtatttgcttttctgttcctgcattaatttgcttaggattacagcttccagctccatccatgttgctgtaaaggacatgatttcattctttttcatggctgcatactattccatggtatatatgtaccacactttctttatccagtctgccactgatgggaacctaggttgatcccatgtctttgctattgtgaataacgtggtgatgaacatatatgtgcatgcatctttttggcataatgatctgtttttctgggtatatacccagtaattggcttgcggggtcaaatggtagttcagacacttctcaaaagaagacatacaagcagccaataatcatatgaaaaaactcccatcatcactattcaacagagaaatgcaaatcaaaaccacaatgagataccatctcacaccagtcagaacagctactattaataaggtcaaaaaacaacagatgctggtgaggctgcagagaaaagggaatgcttacacactgttggtataagcagatgggtggtggggatggaaatgagttcagccactgtagaaagtcgtttggagatttctcaaagaacttcaaatagaatttgtttttaaaagcatacaagccatgtttcaagtgctcaatagccacttatggttgttatcctcttgcacagagcaggtctaagtgttctgggggccactatacagttgagaatagggaatgacatcatcttgttaccttctagaacagggtgtccaatcttttggtgtccgtgggccacactggaagaagaattgtcttgggccatacacagaatgcactaacactaatgatagctgatgagctaaaaatgaaaaatgtaaaaaaaactcataatgttttttgttgttgttgttgttgtttgtttgtttgttttgaaacagagtctcactctgtcatccagactggaatgcagtgacgcgttcttgactcactgcaacctccgcctcccgggttcaagtgattctcctgcctcagcctcccgagtagctgggattacaggcatgcaccaccacagctggctaatttttgtatttttagtagagatggggtttcaccatgttggtcaggcttgaactcctgacttcaagcaatccacccatctgggcctcccaaagtgctgggattacaggcgtgagccaacacgcctggcctaaaaatctcataatgttttaagaaagtttatgaatttgtgttgggctgcattcaaagctgccctgggccacatgtggcctgtgggccattggttggacaagctcattctagaagaatttttctggaaactgcatgaagaacagacttgtacagggaccagaatgaaagcaagaacggtggtaacagtgcaggtgagaggagatgaggacagtgccgggtgttaaggtggtgctgagagtggtcagatttaggatctattctgaaggctgggctcacagcctctgctaccaaaatagacatctcatggaagacaaagggagagactgagaagggagaaagagaggggaagagagaggggggagagggagagaggaggaggagagagaaagagagagaggagagagagagggagagagaggggaagggagggagagagagagagagatggagacagagatagtcagagttgggggagagagaggggaagagagagtgggaaagagagagggagggaaagagggagggagagtgaagaaaggggagagagaggaaggagggagagagggagggaaagagagaaaggaagagagagaaggggagacagagcagagggaaagagagagggagggagaaagagaggggaagggagtgggagaaacagagaggaaggagagggaaagatgggggaggagggagagaggggagagagagggagacagagaaaaggggagagagggagacggtagagagacagggaggggatgaccaactgttaacacttaagcacttcgctctgtcaacactgttaagtgttaaactgttaacactaggagaaaggtatatgtgttcattgtactagtgtttacacttttccataaatttgaatttctttttttcttaagagccactgacttttaaagccacttggccttgactttctgttcaatgagcaatttgtccggcccatggccaggcagtgggaaatcaatggtcgccatcaatcccgggactcccgtggccacatggctgctcccagttaacgtttctctccaccctgccgtcccgacgggtgcctggcagtgtgcgtggaggatggaggtgtgggtgaggagtgcagcaaattccctctaggacttgagttaggatgtccagtcctgggatcccctagtgcatccttcagtggggcaggtgcaggggctcccctgatgtttatgtcatccttctccaagcagggtttctccttccatttgcctgtccctctttttttttttctttctttctttctttttttttttttttttttttgagacagtcttgctctgtcacccaggctggagtgcagtggtgcaatcttggctcactgcaacctctgcctcccgggttcaagcgattctcctgcctcagccttctgagtagctgggactacaggctcatgccactatgcccggcttatttttgtatttttaatagagacgaggtttcgtcatgttggccaggctggtcttgaactcgaactcctgacctcaggtgatctgcccacctcagcctcccaaagtgctgggatgacaggcgtgagccaccatgcccggccatgttcctctttttcttgggcggtttttggcctagaagctcatctcatcaattgttctcctgccaccagttctctgcgatgccagctatgccaagatctccatttgctgccaaggagctgttcaagccaccctgttatggaggctcctggcattgggatctgcagcctggctttgtttagtttatctgctctctggttacctaatgtctcattgaataggtcagcttctgtctcttccaattattttcttaagaaggcaacaaggctttccttttggcctctctaacagatgcttcatcaatcttgatcacatacttaacccacattcgctggctttctcccatgttattataagtttagaaaatccacagtaataaatggcagatctttttaaactcttgtaatatatcctctcttagctgagatgtgacttcagaaggatcgtttgtatcctaattcattgtttccctgtgtatattccaagccgtaagttctctgaggacagggatttattcttgtctgattctctgacccttaaactgtgtctgatgcatcgtagaaattcaataaatgtttgtgtaatgaaagaaatgtccctattgctacaaccataaccccttgttaattgggccatcattcagaaggaacaagccatttccccggagacataagacggttaacaattcacaaagacttctctggcctcttcagccttcaatgccattgttatgcaaaaagtatttgcaggggatatttttgggcaggctacatttactcagcgactacccatcaagcgattttgctttcatttcacaaatactttggggagccagggagccgagcactgtgctgacctccaaggataaaagatgaagggcggaggatcatttgaggccaggagtgtaagaccagcctgggcaacatagtgagactctgtctctacaaaaaattgaaaaattagccaggcatggtggtgtgcgcctgtggccccagctactgaattggctgaggtgggaggattgcctgagcctaggaggttgaggctgcagtgagctatgatctcaccactgcactccagcctgggcaacagagcaagaccctgtctcccaaaaaaattaagacgaagggccacttgttgctcttaaggtatacccagcatcttaggggaggaagatcccaacacacaaatgagagtcaggcaacgcagagaaagataaatgccatgagaagaaaggcgaaaacattacctagatagagtcccacttctgaaacgatctcaaaagctctcaggaaaagaaattcgcaaaataaaagaacaatgatatttgtagagcttattatgatccaatagcctttgacaaggcagagattgtcatcacctgtaaagcacaaaatgtactcctcattccgtagaggattccgaggctcatggagggaaagggacctggcctggatctcacagctgagaaggcgctaagctgggaccccgccccaccaacctcacttccccactgggtggttctgtctggggggatttggtgtgaggcactggttttcagtattggttgaacagtagactctcaaaccatccctaaattctgactcagttggcctggggtcctgctgtttctaaagcaccctgaaaaacagtaatgaaaattactgtgcattagtgatgtcttttcattctgtatttaattaattattaattaattaagagacagggtgtcgttctgttgcccaggctggagtgcagtggcacgatcacagctcactgcagcctcaacctcatgggcataagtgatcctcctgtctcagcctcatgagaagctgggacttagagacttaagccattgtattctacctggtcctcaaatctattttaaagcctttagttaggatattatgcagtgagcattatgggcttattcaatgaatctaaaaatgacttagagacagggaataataaagaggccactctggcaggaacagtttcatctgtggggaccctggtgtggagcactgcaagtgatcttgtgatgtttttgcaaatgctctggaagaaaatgtgcccagtgaagtcactgacgcagcacatgaccttggaccttcccgggtggtaggatgtgaggccagtggagaccaacattaggaggtgttccgggctgagcgtgtgagcagggaagtggcgaataagcttctctgaggcaaaccctggaaatgcagccagggaaaaataacttggagatgtcagctgcaacccaaggaaggagcgagaaggccctgtgcagtcctgctggaacatgtcagctgagatgagatcagaatgctggaccttagcaggcagggcatcaggtcattggaggacagagttcattattccattgctttcgaaatgcctcatcttccatcatttcctccccaaaccctgcaccccagtactggtggctcctcttaactttttgtttttttagatggaatcttgctctgtggcctaggctggagtgcagtggcatgatctcagctcactgcagcctctgcctcctgggttcaagcgattctcctgtctaagcctcccgagcagctgggatcacagtcacccgccaccatgcctggctaatttttgtatttttagtagatgaggtttcaccatgttggccaggctggtcttgaactcctgagctctagtgatcctcctgcctcagcctcacgaaagtgctgggattacaggtgtgacccactgctcctggccatcctcttaacttgtgtaactgtgcttctgaatatcgtctttccctccacagcaagtacctctatcttgcaaatttccagcaccctttaaatcccaacttaaaggcctccattgagctggaatttaaagggtggaatttaaaggtagaatttgcaagatagcaagtagcactaccttgcaaattcccagcaccctttacatcccaactcaaaggcccccttctctaggagacctcacacaaccatgcaccgggccatgactgctcagaatgaatcaccccaactctgctcagacctgtggaaagtgcattaaaatgatctgttcaatgtttgcgtcatgcacagtgagctactcataagcaaggggtgcatcctacacagtcagtactcaatacttacttatgggatgcaccaatggagagaagataaactgtgtttcaagacagacacacagagctgggaaaggtcccaagtcagccacgatgaccttggggagggaggagccaccacagagatgcatgtctcttcaggatggaagaaagacggctaagataggtgcaagagacgcatccaaatcctcgaaaggtatggagaaggtgaataaggccagctcaccacatcacagagtcctggaaaaaggaggcaacttttgatgtttgaaaaacactttaggctgggcccagtggcgcatgcctgtaatcccagcacttccagaggcccaagcgggaggattgtttcagtccaggagttcaagaccagcctgggcaacatagtgggaccttgtctctacgaaaaatttaaaaattagttgggtacggtggtgtatgcctgtggtcccagctacttgggaaactgaggtgggaggatcactcaagcccaagaggtcaaggctgcagtgagctatgattatgccactgaactccagcctcggcaacagagtgagatcctgtctcaagatataataaaagaaaagaaaagcttaaaatttgttttttcaaatgaatgaaagtggccatgaatcattgtgggtacaaagtatgctttaaaaaaatcagctttgtttttgtaaattacatacaattaaatgcaactattgtggtcatgtagttccatacattttgacaaatgtatacacccacgacaaccatgtaaccatcactgctatcaagacagggactatgtctatcacctcttgtacccctttaaagtcattcagctgcatcccccaccttgggcaaccactgatctgctctctctcactctagattagcttgttctacagcctcctgtgtgcatttttgaggctatattaattccttcatcattgtgtttttgagattcatccctttggtgtgtatcaggagttggatcttttccattgctgcatattattccatatgggccttgttacagtttatccatttacctgttcaaggtatttccgttgtttctagcttgagtctattaggtataaaactgctgtgaacattgtgtacacgtcttgttgtggatgagacacagtgttaattaaaaaaaaaaatgaaagaatctcagagctgggcccgggtgcggtggctcacacctgtaatcctagcacttggggaggctgaggtgggttgattacctgagctcaggagtttgagatcagcctgggcaacatggtgagacctccgtctctactaaaaatacaaaaaattacccaggggcatggtaacacatgcctgcaatcccagctactcaggaggctgaggcaggaaaatcacttgaacctgggaggcagaggttgcagtaagctgggatcatgccactgcactcccgcctgggtgagagagccagcctctgcctccattaaaaaaaagaatctcagagactcagagctggaagggagagttaagcaggacgttaacttgctaaatccaaccctcttcctgctgccttccctcctctatcacacccctaaaaactggctatttggtctccatttgccccactgacagggaactcactacctcctaaaatagcctattcagtgaatgcttccattgctagaaggtttttttttttttctttttttttcttttttgaggcagagttttgctcttgttgctgaggctggagtgcagtggcgcggtcttggctcacaacaatctccgcctgccaggttcaagtgattctcctgcttcagcctcctgagtagctgagataacaggcacctgccaccaagcctggctaattttttggatttttagtagagacaggttttcaccatgttggccaggctagtctcgaactcctgacctcaggtgatccccctgcctcactgaattgcaaatggccagtagacagggttcgccctcagtggtgctacagtgaaatctaacttatctacatagtcagatatttgaaaacagcctcaaattcacctccagtcttcccccatttaggctacatgtcctttgttctgccagccactgcaaccaagactgactctagctcgtggccgttccttttgcactgcaccatgaggagctgaacacattgccccagccacagccaggccggctcagtgctggccagaaatccctgcttctgcccaccatgcagaagtgactctcgctggggaccaccaccacacatcgctgactcccacagagctcacaggcagcaccacagcagcctccgggcgtttctcacatgcgctgctatcaaaccatggccccacaccctgtgtttcacacagtggggagcagatttatggaaatggaacaggcttgcaaatacagatagcttcaaaaatgactcagacaacttcatggttgagagacccgtaatggcttattacggcaaactgggatgttctgttgtgtatttcttgtttttccggctgacatcaagataaataactgtgttggactgatggtttctgaggccccttccagctctaaaattctgtgactctttgtcctcccaccaaatgttctttggtgccaatgttggccccagaatgaagccaactggaccagggacggattcaattgtaacgttctctgcaaggagaaagtagaggaaagagaaaggaaggagagggtagcaagaggcagcattactaaaaattccaaacaccattcagcatgagttggacaaagtctgttctcctgcatctgggggaagacagttgccagcaccacccacacattaaaccataacttactggagtttccttactgtttattataaagtgaagtgtattcatcttgggatttttagaagcaaaaggataattttaaagaaaaagaccacctttaattctatacaggaatgactaccattaatatctcagtgcatttcagccagatgtggtggctcatgcctgtaatcccggaactttgggaggccgaggtgggcggatcaggagtttgagaccagcctggcaaacatggtgaaaccccatctctactaaaaacacacaaaaatttagccaggcgttgtggcttgtgctgtaatcccagctacttaggaggctgaggcagaagaattgcttgaacccgggaggcggaggttgcagtgagctaagatcgtgccactgcattccagcctgggcgacagagtgagaccaggtctctctctctctctccatgtgtgtgtgtatatatatatgcatttccttccaattctttttaaatgtttatttatctttagatcaatctatccatctgatatagtttggatctgtgtccccaccgaaatcccaacttgaattgtaaactccagtgttgcaggtgtggcctggtgggaggtgattggatcctgggggtgggtttctcatgaatggtttaacaccatctctcttggtagtgtcctcacgatagtgcgtgacttctcgtgagatctggtcatttagaagtgtgttgcccctacccccccttgctcctgatttcaccatgtgacatgcctgctctctcttcaccttctgccatgattggaagcttcctgaggcctccccagaggttgagcagatgcctgtgttatgcttcctttacagcctgagaactgtgagccaattcaaccccttttctttataaattacccagtctcaggtattttatttatggcaaggcaagaatagcctaatacaccatccaacccatcaacatatgcccatgtattccaatttttgcaagagaaaaatggcataaatgattttcccaactaacactgtcttcaccattttcccatgccattaaaatttttttttaatttttattttaagttctggggtacatgtgcaggatgtgcaggtttgttacacaggtaaacatgtgccatggtggtttgctgcagctatcaacctgtcacctaggtattaagcccagcatgcattagctatttatcctgatgctctccctccccagaccccactgctgacagtccccagtgtgtgtcgtccccctccctgtgtccatgtgttctcattgttcagctcccacttacaaaagagaacatgtggtgtttggttttctgttcctacattagtctgctgaggatgatggcttctagctccatccatgtccctgcaaaggacatgatctcgttcctttttgtagctgcatagtattccatgatgtatatgtaccacattttcgttatccagtctatcactgatggatatttgggttgatttcatctttgctattgtgaatagtgtggcaaaatattctttcaaaatgtaaactattcaatagcattccatgaagttgataaactgtaatgtgtctcatttttcagctcccacttattaatgagagcatgtagtgtttggctttctgttgctgcattagtttgctaaggataatggcttccagcttcatccatgtccctgcaaaggacatgatctcattcctttttatggctgcataatattccatggtgtatatgcatcttagacattcaggttgcttgtaattttttcctattaccacagtgcagagacaaccattcttgtacatggatctttgtattttcagttattttaaagatacatttgctgaaatataatttggggccaaaaaatatgaactttcttaagacttttcatatgtatgtgtcacccacttattctccataatccctctgtgcctctgcagtcatgtgcttccttcctctagtaagttttcagaataatggagcaggtcaactctcagttttatgccctcattgaacaaaacccagaagagtgaaaggtaaaaatgacatgcaaaatactaaatttctctccaaggattctaggcctcataagtgagggaaaaaacacaaacagtcagaaagaaaactggagttaaactgacataattgaaacaaccacatactaaatatcctggtggaagccagaatgccaaagagcattgttatgtcaagaaaatgtcccttaagcaagaatggcaggtccagtaccattaatgcctggcagctcttagagacggtgcccacatagctaaaggaacctagtcccttgctgtgttagttagtgagggctgccatagcaaaacaccatagactgggaggcgtaaacaacagacatttattttctcatagttctagaagttggaagtctaggcccaaagtgtttgcagggttggtttttctttggcctctctccttggcttgtagatggcgtcttctccctgtgttctcacatggtccctctgtgcatgtctctgtcctaattacctcttccttttttggggggcagtggggggagaaggagtcttgctctgtcgccagactggagtgcagtggcatgatctcggctcactgcaacctccacctcccgggttcaaacaattctcctgcctcagcctcctgagtagctgggactacaggcacatgccgccacgcctggccagtattttgtttgtttgtttgtttttgttgttgttattgttgtattttagtagagacgggggtttcaccatgttgctcaggctggtctcgaactcctgagctcatgcaatctgcctgccttggcctccctaagtgctagaattagaggcgtgagccaccgcaccccgccctaatttcctctttttataaggacaccagtcagattggcttagggtccaccctaatgacctcgtttgaacttacctctttttgttgagacagtgtcttgctctgttgcccaggctggagtgcagtggtgtaaccatggctcactgcagcctcgacttcccagacttaacctcaacctcccaagtagctaggactacaggcatgtgccaccatgcctgcctaatttctaaattttttttttaatagagatggggtcttactgtgttgccaggtctgatttcaaactcctgagctgaagtgatcctccagccttggcctcccaaagtgctgggatcagaggtatgagccaccatgcccagccttaacttacctcttcaaaggccctgtccctatgtagtcattttctgaggcactggggattagggattcaacatatgaattttggtgagacataatttagcccataatcctcacctagtagaaggactggtttatgtggacagggctttgtgtttgtaatctggtttcaccagcttctaatgcaggaccccaggcccttgcaaagtacccttccttcaaatatttctgggagtccttcagggagtatcaagcagattgtactttccatgatggctgcaacactatctcatatcttattagctattctgcagtgtgaccttgcctttacccacatcaagacgtagagcctaatatccattcctctggagtctgggctggccttggtgacttgcttgcaaccaacagagagcagcagaaatgatgctccatgatctgtaaggccaagttagaaaaggccgtgcagcttccagatattccctcttggagtccagctgccatgttgtggggaagcccaagccacaagaagccacaaaaatgcactctggctcatagcccacactgagcccagctagcaagtgatcccagctcaggcatcccagctgagggaaatccccagccacttcccagctgtgccctgaatggattcctgagccccacaacctgtgagcatagcaaaatgactgttttttttttttttttttttttttttttttatcatttttggatgatgcagctaaagcctaaagaggtactgctgctcgcttaaagttattttgctgattaatggagctggattaaaatccagacctcataaattttcaatcagagctccttccaccatttattctttcaacaaatgtttactgttactagggctccacgtgctgttttgggcactggggaggtggcagtgactcctgaatctagctccagaggacagaatgaggactgatgggtgatccctgtggagaggctggttacaattcggtgtagacaagacctctggagcaaggagaactttctgcaaatggaatgaccttgaggggtgacacagaggagctggatgtctgggacagatgattggatttaataagcattgagatcagccccaactctcccttccaacttggggagtctattacttgcaaactttgtttctaaaaggatttaaagcaactttattttatttgactcacaactacctcttttcttttctttttctttttttttttttttttgagagatgaagtcttgctctgttgcccaggctgaagtgccagtggcacaatcttggctcactccacctcctaggttccagtgattctcctgcctcaacctcccaggtagctgggattacaggcacacgtcaccatgcccaactcatttttgtattttcagtagagactgggtttcaccataccggccaggctggtctcgagctcctgacctcagctaatccatccacctcggcctcccaaagtgctaggattacaggcataagtcaccaagcccagccaaaactacctcttttaaccaaggtgctctttaagaaagagttcttcagtcagtgtggtggcgggcacctatagtcccagctactcaggaggctgaagtgagaggatcacttgagcccaggagttcgaggctgcagtgagctatgaatgcatcactgcactccagcctgggtgacagagcgagatcctgtctcaaaaaaacaaaaagaaaaataaacccaaaaccaaccaaataaaaaatattaaaaaaaagaaaacccttctactaaattttatgatgtcgtctgtacaatatttgtcttgcctacccccaaagtagaagacagcatcaggagacataggttcaaatcccagctccacctctcactagctcggtggccctggacaaatgatttaatatctgagcctcagtaaagtggaaaaacacacttcccatcacacagggattgttgtgaggattaaaatacttatgtaaaaatcaggtggagagatgtctgttgaatctgttgctaaagcctctccttttcaccaagtaaatatctcaaactttctacatctgttctgccctcaaaggctcccaattccctccttacctcacattgaacaggtgacctagctattttagagagagagcgaagaaaacatcaggtgcatctccctaaatttcccctgataattcttctaactaagctatgacctctccctggttctttctgcagtggactagatagtcctcctccacgtaagactaaccctccacttcacagaacgttccagagatttgaggctgctgagctgttggtgaccaacccattctcctgggtccccctttctacagaacacaagcccatatctttcctgccatcttctgtctaacctttgcattaaacctcttgaaaatgtcatgtccgggcccggtgcagtggttcacgcctgtaatcccagcactttgggaggccgaggtgggtggatcacgaggtcaggagatggcgaccatcctggccaacatggtgaaaccccatctctactaaaaatacaaaaaattagccaggcgtggtggcacacacctgtgtagtcccagcaacttgggaggctgaggcagaagaatcgcttgaacctgggaggcagaggttgcagtgagctgagatcacactactgcactccagcctgggcgatagagcaagacaccatttcaaaaaaaaaaaaagaaaatgtcacgtccacctccagctcatgtctctaccacctgggactggctcaggcacccatcaacactgtgctcacggggtctttgaaggagctctcttgctcagcctacaagtcacttttcagtccttcactccttgtctgtgttgcccttttttttttttttttgagacagggtctcactctgttgcccaggctggagtgcagtggcgcgatgtcagttcgctgcaacctccacctcctgggttcaagcaactctcatgcctcagccccctccgagtagctggaattataggcatgcgcccaccaagcccggctaattttttgtatttttattacagacagggtttcgccatgttggccaggctggtcctgaactcctgacctcaagtgatccacccatcttggcctcccaaagtgcaggaattagacgtgagccactgcgcccggcccagtgttgcctttgaagtcatcttcctctgctccttccttctctgcattatacccaacatccacatgtctaatgatcgtatctgcctgaggatgtcctgctgacacatcacatttaacagattaaaatcaaacgtggcactgtcctccttatccctccaaaccttcccctccacctgtgttctctcccttcagaaacaaaatcgccatttttccagtttcctaagccagaaaacagaacgttatctgcaaacctctctttcttagctgtggattctctctccaagatagcttttttgttattgttgttgttgttgagagagagtcttgctctgtggcccaggctggagtgcagtggcatgatcttggctcactgcaacctccgtctcctaggttcaagcgattctcctgcctcagcctcccaagtagctgggattacagtgtgggccaccatgcccagctaatttttttgtatttttagtagagacgggggggtgtttcaccatgcaggccaggctggttttgaacttctgacctcaaatgatccgcctgcctcagcctcccaaagtgctaggattacaggcgtaaaccaccgcgcttggccatagatagctttttaatctgccacttctctctcgtcccaactgccaccattacttcatatttgaattgctgcaacggtctcctagcagatttcctggctcccaggcttgcccaatcccaacctagcccacaacctgaattacttttctttgtctttttcttttttccaagatggagtctcactctgtttcccaggcgggagtgtagtggcttaatgtcagctcgctgcaacctccgcctccctggttcaagcgattctcctgccccagcctctggagtagctgagattaacaggtgcgtgccaccatgccaggctaatttttgtaattttagaggagacggggtttcactgtgttagccaggctggtctttgaatgacttttctaaaagtctttgattctgtggtttttcaaatccccatgcctctccattgttctcatgctcaagttcaaactctgggcttcaaacttttggcaggtgctgttccttctgcctggaacacactttcttctcctgactgttgagggatgaactcttaactcgttcttcaggtcttagtttagacactacttcccctggaatagtttccctgattcctcaaggctgttagatccctgctctgatattcccttaggtgatttcacttatcatatgaatgcaattactctaattgtttatttcactcttgcctagtgctggggcaggcatcaatcagttatctgacaaacacttgctgaaaagtaggcatggaaggaattgctttcgactatgggtatcaagcttgagtgtatatcagaagcacctgggccgtgcatggtggccaacacctgtaatcccagcactttggaaggccgacgcttgtggatcataaggtcaggagattgagaccatcctgaccaacatggtgaaaccctgtctctactaaaaatagaaaaaattagctgggcatggtgatgcatgcctgttgtcccagctactcgggaggctgaggcaggagaatcgcttgaacctggggaggtggaggttgcagtgagctgagatggcaccactgcactctagcctagggacagagcaagactccgtctcaaaaaaaaaacaaacaaaaaaaaaaacaaaaaaaaaaaaaaaaaaagaagaagaaaagaaacacctggtgggctggttaaaccatagcttgctgggttccaccccccagagtttctgattcagtagtgtggggcgatgtccaggtgatactgataacagctggtcaggaaactctgcttcttgcaatttaaggcaccccgagagctgagggacagttactattaaaggcagctggtaggcatttttggaagcttggtacatttctggtaccgctcttcttcatagcttccttaataagagcatttaatcggattatagcttttgaagatatctcaggaaactaggtaaccaaagcacgcgccccattagggctcaaagctgcacctggaactgcgccctgcttgttaatgggttgccaggcaacagaacaaaggtgaggctgaggcgggatcagcagttggcagggatctgagagtgaaccactgaggcaactagaggctggagttctcatcaggacaggaccttagggaccagccattagggacccccaggatgtggactgggagccttgcattgcacacgggagagcatcacatccccaggtggacaagtgcatgttgtaagttggcctctgataggattggggattatttttctcagaagtagaaccatgggaacccatgggggagatttcctaacgacttatgggtaagaaaaaacttcttaggctcaccaccttccgcttcttaaaagcaagctttattagtgttttggtttttttttgtaaattatgacatacacattcacatttggaaatataaaaagtacaggaaagatcccgccactgcactccagcctgggcgacagagcgagactccgtctcaaaaaaaaaaaaaaaaaaaaaaaaaaaaaaaaaaaaaaaagtaccggaaagcacataattccatgtcccctgaaggaaattatatacattaggcattcatcctttcaaaaacaaaacaaaaaaaaagacataaatgagattatatatttgctccataacttttaaaacacagaactgtatatagcagacatttctacatcagcacttttaacagtcatccagaaatgtattgtgtggatatgccatattgcacttttttttttttttttgctactagtgatgctgcactggacaaccttatccatatgtctttttgcatgtgtgaggtataatagatcaaagacaattcatatttaaagtttaactaccggctgggcacagtggctcatgcctgtaatcccagcactttgggaggccaaggtgtgtagatcacctgaggttgggagttcgtgaccagcctggccaacatggtgaaacccatctctactaaaaatacaaaaattagccaggcatggtggcgcgcctctgtaatctgagctactcgggaggctgaggcaggagaatcgcttgagcctgggaggcagaagttggggtgagccgagatcacaccactgcactccagcctgggtgacagagcgagctctgtctcaaaaaacaaacaaataaattttaactatggattgcaggtttctctccacggcagctgtttagtttgtacttacactaagaataaatgaatgctcatttcctcatagtcttaccacacatttgccattatcagtcagtccttaaacattttttacaagcctcgttgctttaatttttcactgttaagatcaatttctggctgggcgcggtggctcacgcctgtaatcccagcactttgggaggctgaggcaggtggatcacttaaggtcaggattcaagaccagcctggccaacatggcaaaaccccgtctctgctaaaaatacaaaaattagccgggcatggtggcatgagcctgtaatcccagctacttaggaggctgaggcaggtgaatcgcttgaacctgggaggcagaggaggttgcagtgagccgagatcacaccactgccctccagcctgggtgacaggtgagactctgtctcagaaaaaaaaaaaatcaatttcttggtgcatctcttcatttattttctctttatatctctctgcctgttactattctttggtcttttgttttttgagatggagtctcgctctgtggcctggctggagtgcagtggcacaatcatggctcactgcaacctcccaggctccagtgatcttcccaccttagcctcgagggtacctgggactacacacacatgataatttatttatttatatatttttttgagagatgagggtctcactatgttgcccagactggtctcaaactcctaggctcaagtgatcctccctccttggcctcccaaagtgctgggactacaggcctgagccatcacacccagcctctgctcatttttctatagggcttgttcatctatttttcttattgactcataaaagctgtaagtcttattgactaacatagatagtaacattttctccagtttgttagttttttttcacagtgccatacagatgcttttggttttgaattggtatacagttcaagctactgatgttctagaaagttgcaaattgtccttttaaaataaaaatatttctatcatttaaaaaaggttctcttttatgtgatggcccataagaaaaaggaggagaaaggacagaatgaagcaaaagaggaatgagggctctattatattcctcagactcaacgggattgatgagtgattttcgaactttcatttacacaggaatcacttggagatctttgaaaatgcagagtatgagtcagcaggtccgggactgggcttgagattttgcatgtctaacaagctcccaggtgaggtagatggcccacgggccatacctggagcagcaggctttaaatcacaacaagggaaagcactgctggtttcatggatcatcctaacgacgtgaaaattatcatctgttttgaaaactcttccttctctctttttaattaagcagggaaaattctaacttcttattctggaaagtaggagatggccagggctcattgggggaaggagaagaagaaggagaaggagaggaacaggaagaggaagaggaagaagacaaataagtggaagaggaggaggaagaggaagaagaagaggaagaggaagaagatgaataagtggaagaagaggaggaggaagaggaagaggaagaagaagaggaagaggaagaagacgaataagtggaagaagaggaggaggaggaagaggaagaaggaggaggaggagaagaagaagaaggggaaataataataatcagttttcatggagtaacatccctccacctcatggcctttagcgtatatggttacaatttttaatggcaagtatgcaggtataaaatgctcacttcttgaggccctcttgtagggctgggcaaaatgaagttgagagattcactggccttaagggcagaaatattccagccccctcctggctgtctcccctccccagcattataaaggggtttctctgtattattgtttgagaaagaatagctgtagtctaaacacaggccccaaaatggtaacctaataggtcctgtgaaaagcaacatggtcggggcgaggaaaaacaagtctcagaacaggactcaggagagctggatgcttgttctggctttagcacggttgcttcgcatgtattaaactttctaggcttggcttctccaactgtagaatggagattagagtagaaccttatttctcaaggctgatattgggataggaagaaaaaaaaatttcttggagaggtttccagaccttctgtagtaacagtgaggtcactgatctgtcttttttttttttttttttttttttttttttgagacagagactcactgggtcacccaggctggagtgcagtggcacgatctcggctcactgcaacctctacctcctggattcaagcgattctcctgcctcagcctccttagtagctgggattacaggcgcccgtcaccacgcccagctaattaattatttatttatttatttatttattttttaactatagatggggtttcatcatgttggccaggctggtctcatactcctgacctcaagtgatccacccaccttggcctcccaaagtgctgggattaaaggcgtgagccactgcacttggcctggtcactgatctcttataacctggtgtatactaacttggctttccaatttccaagcaagtttccacaaagctttctgctacctgcaaaataagtcatggcaaaagaggctctgggtaattttgacgtgtcctaaagtcaagaagttgcttgagttatgttcgtgcctatgtggactggagcggtatatgggcacaggtttctacgtgaaagtggtggatatagatcgatactggagaggaaaaggttaaatgtgcagcaaactcaaatggcggggagagcaagggtagtttgggacaaggattgccacgttagtagagggaaaggaaaaccagcatttactgagtgtgaattatctcactctgtctactaccctggagatgggaattattcctaactttttacaggaacttggagtcagcgatttgcccaaatttcacaactacaaagggcggagctgagtgagacctcaaagccccatgactccactcttggatcaccagcctctatctcccagcaaagcagaggtggttggggtgaagaggaagggaggtgagctcccgaccttgggcaaaacacttcacttcctttatttatttatttatttatttatttatttatttatttatttatttattgagacagagtctcactcagtcgcccaggctggagtgcagtagcaaggtatcggctcactgcaacctccacctcccaggttcaagcaattctcctgcctcagcctcccgagtagcttggactacaagcgcacgccactacgcctggctaatcatcttcttcttctgtctttcttcttcattttcttctttcttttttcttttcttttttttttttttaactgcagacgaggtttcaccatgttggccaggctggtcttgaactgacctcaagtgatccgcccgcctcggcctcccaaagtgctgggattacaggtgtgagctaccgcgcccggcccacttctttatgcctcagtttctccatctgtaccagggccagcacctctcacacagcaggtagtgaagctgctgctgctgctgccctgggctggcctacagtgagtgctcactgcacaggaggtattgcttccccccgcccagcaggttctcattataatcttgcaagtttgaagaaacccagccttgctaccaacagaagataaaaacagacatgcctctctgcctccagtctcatccccatgtccttggggagctgtcctcttccggctcgtcccatctatgcgccctcactatatcctcagaacagggcactccgtggctcctttaacttttttgcccctcctagcatggtgtggaaagggggcagatgggaggcctctttctgaaaccacctcctgttcggcggctgtacttggacctcagtttccctgttttgttcacgtggtcattgttaagtcttaggggacgtgtacagaggctaatattgagccaccaatcagttatttgacaaataccataggcgctctgtgagcaggagctggctcctatcccagaccccagccctgtgacctgctctccactcgcccggggtctttcttggctgggacaataaacctactgcatcaggtgattcctggggagtcagccccgtgctgggctcacacccagcccctctgcgttcatctcttacatgatctcatgcgaccatcatcacacgtccccaggctcctcccgggccaactccagaggcagtgcgtgtcacctccagctctcctcccacaaaaatgctggcctttcagcctccagtgcgcttagttcaccccataaactctgctaatgcttaccacatgctgagcgtcggcgcccgtccccacccccagccccacaggctcccgggtcccgccctgggagaccctcccactggccgaccctgccccaagactcgcccactccacggtgggaaacctgcaatgtgtccctccctaccccgccctcctccagcgccggccaaaagtgaccttggacgcttctacaatgccatatccactcctctgaacaggaggcgagtttgcacccagtggtgcctttggttgctagaaattaaaaacccgattgcgcgtgtttgcaattacggtaacttggcgcgtcacccccaagcactgagctagctggtggtagccgggcgcctctcggggcgcgccctattccgccctcggccctgggctgccgcacgatctgcgcgtcctgctgcacctgagcccttcccactcgggcgcccgcaccgctgcggggccgggcgaggatgcaccacccccgcccgcgagcccgccacgggagcgcgtgccgaatcgacgccgcctgcagtccccactacgggtccctagggggcgcagccggcgcgggaagccgcccgagccaggcgccgcggccggcacaaaattgcaggcgggcgggcgccgcgactttgaaaacaagcgagggcctggggggcgggccctgggagcgggcgccgcctccctcggccaatcaacggcgggcggcgggcggcgggcgcgggcggcgcgtgcggccgggctgtgaatggggagcggcggccgcggcagctgagggcgagcgcgaccgcgacgtgcgggcgggcgcactttcttctcagcgccgggcgggggcggcggcggcggcggctcctccgcgcccggcggacccctcggagctagcgcggcgggctcgggactgcgtgagcgccggacgcgaatttcccccgttgacaacttcttctcgcccggctcgtccccggcccgcgccgcgcccctcacgcggggacccaggacgccgcccctcagcgctgggcggccgctcacctcgggccggggggcgccgcgcctcccgcggagtggccgcgcccgctcggagccgtcccgcctgtcctgcccgcccgtccgtccggcgcggcgctcggggtggcggctgctcggcatggcccggggcgcccggccctcggcggccggtggcggcggcggcggcgcggagccccctgagcgcgcgggccccgggcggccgcggggatccccgcccggccgcgcccgcccctcgctggcgccgcgccccggcccggagccctcgcgaccccgggcggcgcccgagacctccggcggggacacggcgggcgcggggcggtgcggcgggcggcgggcggcaaagttggggccgggccgccgcggctggtgggcgctgctggcgctgcagctgcacttgctccgggcgctggcgcaaggtaggtgcgcgcggggtcgcgggccgggggcgtcgcctcggggcgcggaggcgcgaacttgagcagcgagagtgtgtccggggtccccccgcttcccggcccgggtcgggatgcgccttgctgggggctctagggagcccaggggctcctccacgccagactcggaggagagggaaacggagccccgtagagcctgcaccccgtctgctactttgcgttttattttttttataccgcagtagcacaaacaaaaatttttaagttgaggacccatttctcagctccttaaaaggatgcccgagtccccttcccattgcatggatgaaaaaggggctggtctgtacctgagtcttcgcaccgcagggtctggtttccggtgagtgacatccagaagacttggaaatatcaagtgccagtcgctgtgaaaagccttttccagcccctccccagggcctcgtcctctccccagcccccgcctgctcctgactcccccaagtcccaaagcccgaccccaagtgggtgctgcgcggccggtggagcaaaactttcagtgcccacagcttttgcacttggctttgtttttctccctctattggcttctgtttagaatacagtggtgagctctgaaatagggaaagaggatctgctgaatggaaatgaccttttgaaacgagagatgggatctcttgtgaaacgagctttccttcccaaatctgggcttccctccaccccctccccgcccccgacaaaacccgtaacgtacccctgccagctagcatcgttttcttttgaagtttgctggtctttaaaccaaaacacccccctcaacccagaaataactattttaatacgtcctttggtaacgtctttaaaacacattagtgaactggttttgctgatggtagttttaggaaaattaacttagttgtattccaagatacagctaacgaacaatcatggtaaggaactcgatattctgagattggcgaagatgagagcattaaacttaaattagctgtgttctgtgtcctgtgaagatgatttatgtgtagtaacatgacttaaatgttgtaacattttaaaggtctgagctcaaaactatcatccaatagcttaacaacgaactcatacttttttttattgatgcttatgtaacgttatctaaattgtgcccctccacccccctccagctttcataaatgctccctcttatgttttactacatgaaaacaaattgccatatttctggttaatttaactcctccattacttggaaaattttcatttcacttatttgtgctttttgcttaatgacttactctggaagaaaagcatttattaagtcattttgtacagtgggatctgtagattgttagagcaaccaggttcaagtgaagaaatctaaatcacttaggatgacctttaaaataatgtgtttattaagttttctttttttaaacagtgacttgcattttgcactaagacctgtacgttcatacatttgaagattggtgcacagactgaaatggtggggaaaaaatctgccagtggctttgttttgaagtatattacatagatttcaagtttttatcagttgcactttgaaggttgtgtaaagcattgcattttaacaactgaaatgttaatgaaaatacattttaaaaatatattaaggcaacaaccgaactttgttaggaatattttattcctttttggcagtaaaaacattggtacctgttttacatttatatggcttatgaaagtgtacagatcttttagtgtaaaatttcagataggttgtcacaaattttaagttcattgacgggtttctgttctctttgctctgtgaaatgtgtaatatatccatctttttttatatcgtattgaaaattcatattacagaggagatgtcaccatttgacaaaagctcatgtatcttgaaaatgaaaattctggtgctgttataagagatttctgatgggatgatgagttggtcatatgtgcaggagtgcattctcttgaatcttatcagatgtaacattctaaatggaatagttaccactacgttggagcgcctcctaagtaccatattattacattgtagctaggtgaagctatgactaatttctctgcacctcatgtaagtaggctaggtcgtgtattttgagaaaaaacgtgcgacattgatcagtaaaagttacatttttataacctaggttacagaccctctatgtaactgatcatgatgggaaccgccaggttcaggtcttccaaatgtaactttaatatgccctggagtttcttctttctatgcggtgatgagaatttctgagttgtatgctctgcttattgctgtgtgtttaattgcttgtgactttcccggattcctaaaaagccaagtctttaattctggaaggcaggtggcaacacatgctttctttatgccatccaccaaggagccagctgtgagtggtttggaaggatgacttctgaggctaaagatgtataagcagtcttatgtgtgaagtccgtggtgcctttagctttactgctggactctttacaggcttactgattctggcagtgttcagtagacctcctagattcagcttgcattcctcaggcctagaaaggataggaatgttcttgtccatggggctgtttgttcatagtcctcagtttctcatttgaaattgtctccacttggacctatggttctccagctttggtatgtgttagaatcacctggggaatttgatgaagctgtagagtacctactcttcctcttccatgagccacatttgctttccatgtgattataatacacattggaattcgagaactactcacttattaccttgtgtttccccctattccagacacctgctgacttcctggaaactctctagcccagtgtttctcaaacttggttgcacattggaatcacctggagctttaaacttctgatgcctggatgtcactcctagaattggttttaataaacttgaggtttgatctgggcatcaggatgctgagacaccccctcctccctccaggtgattctcatgtttagccaagtttgagaaccactgctctaatggttttacgtgaggccacatggcttgatttccctttcatgccttcctgggcttattgtcctcccccaacaattgcagtgacttttatggaccttgggcctgtgttcacttacacctgttccaggttcatgatttgaaactcaacagagtacactagcttttcacttatgtatcgtttattcctactgaaactgttgagcccctgctttgtgctgcctgaggtgtacatcggaatcactggtgaaaatttaaaatacagttatctggactccacctcagaccagttggttctcagaagcatgcatttaaaaactcctcaagtgattcttgtatgtttgtgttactttttttattttttatttttaatcctcgtgttggttaatcccataatgtcactcaatttctctgtcatccttagcctgatttttctgtggtctgggtcacttttctcaggccaattcccagccttggacagggtgtactaattaggcatttctgccacttgtttgctagagtgttgagttcactacaaatctagcttccttttgggcccatgttgctttccattaatccagaagtactttgcttcccctcctcctaacctactccctttacaactttgtaatttgagtttcaactggaacttgagttctagactcccttacttgaatatcatcttaataaagagtcttgcttagtgagtgctcagatagttaattaaattttattaggccactgggtatttaacagacaactggtctcttggttggttactgtcttccaaatccaacaataagcagttattaccctctatgcagtctgcatagccacctgtagctgtcctttattgaacctttacgtgccaagcactaagtgctcatttattcttcacagcagctcctgagaggtagacagcatttttgttctcatcttacctatgggaaaactgaggcattcagatgttaactaactttcctgaggtcccaggaccaggagtggtgatgccagaatgaaaagtctgatccagagtctgaacataacttgagttcataacccctgggctggagcgtttcccatgtagcctctgcctttataaggagagggaaaaatgggcagcaatcagatctgtaccaaagggaaagacggtggttgatattttctaaaaacagtattgagtaatctgacctcaagttttagataaaccttatttacgattatgattgcaaaataaaaattacataatttggaaaatagagatgagggatgtatgtaaccccttccatctacacattcgtctcctctaagaaaatgactatcaccattttgatgtattcccctaccccaatttttctttcataacataacatgaattccagcttcatgatggtctgttggcagagattagaccaccccagaatggactactgggagtgcaccaactatttatttgaggaacatttggaaaattcttttatctgcactgaagtgtatgaatttgagtcctttaactaaaggaggtggagtttgtaaggtactgatcttttattagtttgccttagcacacattttatgtaaacagttaagtttaggctatactggggtttatacctaaccagaagtttcctgggccctcaaatactgagataaaacaacgtggaaggctgcaagttaagtgggtaattaagtgatatcaggtaagactgtgtagtttaattctccctaccagttgcctttatgttatttccatcctcagagcccctgtattgcttgtattggaatacataggatttggcgtctaaggtggcagaggtgtgtggcatgtagtgtctttctgcctgcctgccttacggtgtcccagagatcagagactggtaatgtcagctgactgaaactagagaatggaatggacacaaagtgaggattctgattaggtcacggcttaaatttctctaagaagtaaagaaagtggtagttatgagagtagacctccaggtccaaatgcgttgaaagttgaattaagctcaaggtggggaatgaaaatcacattgaaaggtgtagtataaagaaaaattaaggtttatttacaaaagaaagctattgatgttttgttatttgattaaatactcctggtacccaattatacatttaacccaaagtaaccgagcattttaatttgcatagtttctaaaattttatttgacttcatttctgtaaggcattatcttaaatttccccctaagtatgtacacctcttttttttaaaaaaagggcataaacgttcgtagccataatcctgagggaggacatattttgtcagttgggacagcaaatatggcacctcctgccatcctatggtagcaagtagaaagaagctataggttcttcagtgaatccctgaaatgcaaaagtctgtcacagttagatacctacctgccagttattgatcctatacctgagatctgttctggagaggttactactcttagagcttcattatgtgaacagtgttgccactaaatccaaatacaaaaatcatgattattatgggagcattgctgtagggaacccttgtttatgtatgtgcaattctagtgtttaggtggttggcttcctgacagaaagctccaaagccagaaactcattccatcagcctgataccaatctcctgtgggtattgtgggaatgaaagcagtttttataaagctttcctagaaacatggatatagtaaatggaaaagacattgggctaagtatcagtaggcctcgtttatacttcattctgtaactactgtgcaatatgaggaagtctattagtctctctgagtctgttttctcacctataaaaggagggattagactagatgttcagaattgttctactctgattctctgatcttctatatgttgtcttcctttctgcccttcactagagtctgcatgtgtctcctgtctggggattctgtaactccatatgtcttagcttagaacctaattttcttcattttacttttctcagagtatttacaatgttgaagacaactaagatgcaatgtagtatttctccttaggtgctgccgtctaacacatgatatatttactctagcctaaaaatggttcatgttcaaaattttaggttctgtaaaacaaattggtgccataatttatcagtataagcctgaaatttggagaaataaattttcttaaaatgtgagatgcttatttatatacatggctggaagaaggggcaaggctaacaaatctggaggtaattaatgcagtgagaaacttaaaaagatatgagaaaatggcgatggatgagaatgtttatatttactgtacagtgaccatcagtaatgaaagagattagtagatgtctgtttttgtgcttaacataatgttatgttggtttaattgtcttcattaggggcttttagtaaaacaaagggtctttaaaattaacacagtaatttttcactttaacaggcttaactggcactttattgatatacagacaatgtctagtgaagataacagctatcaattaaatagtccaatttcttgaaaacagatagtcaggtaaatctatttctgatttttggagattaggtagatgaacatgggtaagactatagtttctgcagtgtttttggctttggttcattttcaaaaaaattttttttaaatggataaggctaggctttagagttgtgggttcaaagaatgggctagaccctggggtccatattattacgtagaattagtctttgtgcagtgtttggttgccttttctcctttctataactctccatggtattctagacctaattctttaccttgagggggttggaagctctcaagtgtgtaagcttaattttacaacgatgaatagtctttccaatgagaaaaaaatagagggagataaccacgtaatgactatggtgatttggggaggaatatggaaacttggggagctctggtagttgcctttattaagaatagttggtagcaggaattttagcaacccaagcaggctaattagaatatatttcagttttagagtaaggagggattttgtatcataaaggtataacctatcatacttaactaagggtgctgatttccacaggtggtagtatttgtgagtccctctctctggtgtgatccttaatttattttgtgtgtttgtgagcctgttttcaaagtgaaggtcagttttgtcttctctctaggtgttaggcgcgatgcaaaaagaatgaaagagattttgatagggtatgaccaagcccttctatacaatggatgtcagtgttgatttttatacacaaaccaccagatggcaacagaaaaagtgttcatataggatataatctgtggtttccacagccaagttttttttttttttccttccatgattcaccactttttagtatgcttaggtaacatgtacaatttctggctaagagcaaggcgagtttataatacccagctatgtgaaatcaaaaccaggtaatagaatagtggcagagtgtcactagaaaaagattttttttttttttttttacatgagtgtataaactgttcccaaagggagcaagtttccagggatgcaactttgatttatattattgtatagtcatgcttttacttctgattttttttattcagcatttattcagctcttacagtaagctgtaatgatttgcagaacataaaagaaaacatggctgttaccctaaagcattttatgtaacacctttaaaaggaagagatacatgagttcacaaacattaagcatatttatgtatttgccggccaaaggtatttttactctatgtagaatttgttttatttttgccttgtaggcatattccctttttctaagcgtgctgtcttggctcttctaaaatggttgtcttagctaaaactcctggttgcaagctagaaactcagtctgaactacttaagaaaaaaaggattttattgtaggagtcctggggtatcacagtataattaggagaatttctttacatttggcaagtttagtattcacttccacctagggaataactagagccacatgctcaaaagctcccgggtactgtccttttggccatcatctctcagtttgcttctgtgtctgtgctggcatcattctggattcactggaaattgctttctttttgtggctgaaacccagctgtcaccactctttgcattcctattgcttcagaccctcaaagatagacttaaagctttggtgctgagtccaaaatctgtgaaatgatcagatttgtattttaaagtcatcttgagtggggggaataaaccattatttttgttgcaaaattgagaatgggttggaagaaaccagaatgaatgactgtagatgtgttggactgtaacaacaattgaggtgagagaaagtagcagcttgggctaggtggtggtgctggagatggagagaggtagatgcactagagagggatttaagaggcaaaaaatacatgggatttggtcatgggttgggtatggaaggtgaatgagaaaacatcaaaggtgacgtccaggtttctggcttgcatgactagttggctagtataaccattcactgaggttggaccacctctgggcagcatgatcattagtttggttttgaatttattaatgtgagggacctttgaggcatctagacagagctgttaagttgtgtggatagatgaattttgcaaccagaggagggtctgggcttttggtataaatatttgtggagacagtatagcatactgtttaagaggataggcttggcataaaataaaacaaagttaaccacttgctagctttgcatccttgggttggctacttaatcttcattaatcttgacttttcttatccctgaagaattgtgtaatgattctgcctgcttcctgtagttgttgtgagggctgattgatatgattgtaggtaaggtgtttttatcgcattaccaagtacatagcatgcatccagtaagtgttaggtggtgttatttattcttttgtgtagaggaatcctgccttatttatcttttcttttcctgtaatattagggagtgatgagtcacggtagtagagtggggagtatggacagttgacataactggagaggtattatactaatattagcctggctgggatacaacctggataaattgcagggcgatgggcctggggggagagtagagtgatggagatgagttagggaatggttatgataatatagaaataatatttgaactgcagtagtattgggatggaaaaaatggaatggtcagtcttgcttagagaggtaaatagatgagaacaaaaggccattggatttgttgattacatgggtaatggtgatctttttgagctcaatctcactggagttctaggagtataaagtagattgaagttcattatggaatgaatgggtagggagaaaagagtcaaccggtatgttcttgttctattgaaattctcaaggaaagagaactatggaggcatttgaaatgcatagtgacaaaaatgatcttaaaataccttgggaatattttttccaaatttgaaatctattattgaggctgggaaaaaaaattgtcatttggcagaatggtaagtaattatcacaattctctgaagtgatcatttctgtttcatatgttgcgactcgtggaggcttctagcaacattgtcaccaaagctgaatgtggaggactcccttcaccaccctgctataaacacacagaaactgtggacaaaatataacaagaacaaacaagcgtttctgaagtttaaaataccagggaatccctaggtgccagctatgaacagaaaattcagagctagggcgttaatcaggagctcaaggcctgtggtggtttctgatctgaatacacgccccaatggcttagtcctgagggtctcatggaggagtaggaggcatggccttgggtctgcatagacttggaaggtggagtaaaggttctctagcatcaaaccttgaagggcttttccatctgtgaaaagagaactagaaaaactttgcctactggtttgggaaagtgtaggaaacttgctgtcctcctggggttgtgatcattaggaataaaaaagggacatctaaactccaagattgcacctcataattggggtggattcaaatttaacatttcttatagtgcaactaaccttcaagctgagacaaattagcataaaatctggtctagaactatggaaatgaatagagccctcaggtctgaaactgacctgcagagcaaattaaaaatctaagactcttgcagaagaaacaagtcatgctatagatgagcttgcaatacaaaaattgcccagctacacaaggaaatgaatcaccgtgaaggagagttagcagatgaatagtattccaggagattgagatgataggatatatgaaagagattaattgcttaaaattatgagagatgaaaggggtaagatcataatgaaagagcacagattagaaaaataacatggagttggaaaagaacccagtaggacttctagaaatgaaaataatggtcattaagtgtttttttttaaaaaaaataacctcaatggacaggttaaagagccaggtagatataattgaagataaaaactgtattgaaaaatcaatagatttttaaaggagatctgaggaaatttcttcgaatacagtaataagggataaagaaatggaaaatgagtggttacaattcatgaactttagaatgaggaagtctcatattaccttctgtgagcttccagaaagaggaaatagagtaggagagacactattagaagatagaatggctgagaagttttcataatcaatacaagttctgcctgagctcttagtttcaagaaccgtagtaaaccccacacaggataaataaaaataaattcatacctagacatattgtagatgaagccttagaaaataagaggaaagcagtctgaggaaagttgatgtctagactggcaggcattttgttcatagcagaagatgattgaataataacatcaaaggctggaagtggaaatccactaccaacctagaattccatgtccatataaagtattatgatactcaagagtaaatgaaatggctgggtgtggtggctcatgcctgtaatcccagcactttgggaggccaaggtgggcagatcacgaggtcaagagatcgagaccatcctgaccaacatggtgaaatgccatctttactaaaaatacaaaaattagctgggcacagtggcatgcacctgcagtcccagctacttgggaggctgaagcaggacaattgcttgaaccctggaggcggagattggagtgagctgaggttgcgccattgtattccagcctggcgacggagcgagactccatctcaaaagtaagtgaaataaaggttgtagataaaaaacaaagttgatgattagtagttggaactactaaaaaatgcacttcaaaaagaaagaaattgaacccaggagtgaggtacagattgtaaagtgctaaatgataggaagcattgttgcaatgtgccccttaaatttatatgtaattgctttgcagtttgagaaaagtgtcagcagtttccactacaagtactcatactgcagattaacggattagcgagagtgtaagcagtagggacgggtttgggagatgttggtcaaaggatacaaaatttcatttagaaggaataaattcaagagatctgttgtacaacatggtgactataattaatgataacttgttttattcttgagttgctaaaagtaaattttaagtattcctaccacaaaaaagtatgtgaagtaatacatataattagctctatttagccatttcacaatatatatgtgtcaaaacatgtcgtacacaataaatatatacaaatttttgtcaaaattttaaaaatgtatgtgagcaggagttaattcatctaatgcctcagtgaataaagtgctgtgttaaaggtatagtgatcaataacagttgcttccttcagagagcttatagtttattagggcatacacaccaaaaaatacagcgccaatgtgcagatgaccctggagagccctttaagccatacaggggattcagcatctggtagataagtgttaaataggaccctagcagggatacatataggcaagccatgttggaatctggggactcagattggcacgtggaaatacaaagatgaaggattcaggtggaaagctgctgatcaacaggagtgaggaacccaacacctagatcagaacaggattcttgccaaaggaccaaacatcaagaccttcatatttagccagtacattccaagtgacctttacattctgaattagggtcttattgtcatagctgtaggaaatgtggacttggatcttggccagcagagagttagattaaatgtgcagggtgaagcactgttcagagctgagataaagcatacacaaagaggcaagtggttgagatggagcagctcagtggatgagagttagttacagatgagattgtagccatttgcatttttgtggcaacttgatatgattggttgatgctcatcaattcctgaattttgaaaattacttatatctgtatcatggaatgttatagttggaaagacagaggccatctgcatctctaactttgctgtcttctgtggaatgaaaagcatgaaatataagttgtgttatgcttttatatagatgaatacttcatagcaattaaaatattataatctagtgttttattagatgtagagatgccttaagaggttttattttaaacccacaattgctttacttcaaaaattgctctttcttgggtgaataacgtgaatttcatcatacatcctattggcaacaaaaacttttttttttttaaaactaaacctcatttggcctgtgaattgtcccaaatcagccagtgaggaaacattgggagtcctaacccactctgactttttccttactttagggagcaagctgggttggctagagtcctccatccctatctgtgttcgtcaacagcaggtgaccttcacaaatgatgaggacctgaatgcttctggtggctttcacagtggctgatgtggcacatgagaagactacaatgttagtattaaaaaggatgtttagaagtagctctaattgacatggaaggatttctgaatatattaggtgaaaaatgaggttagagttctttgtagagtgtactagcttgtttttacggagtgcttttcttggcatcaggcattgtgctaaggccttcaagttatacagtatcatacatccttacaaccctattttatagttgaggaaattgaggtccagagaagttaaggtcactcacttcataagtggtggaactgatctttgagtgcacccctgtctctggagcccctgttcctagtcctctccacatgaacagcccttcctgggagtctccaagtaccagctttctctgacatagggtcacgcatgcacatgcaagtagaaaagggtgtggaagtcgcatattataaaacaggtaagaaattactgttttataatatgatgcagtgagtatgattaagaaatagaccagcctacttaatgtgcttatctctgttatagggatttctctttttttcctgaatgttctaagttttcaaacattcagcatttataactttttaaaaattatgaaagcaattagaattatttaccataatgtattattactggattttaggaagaatatggtactaaagttgtttagtggttcagactgagagtgcattaatgggaacctgggattttgtttgtttgtttcctatttgagggaacttgaattattgttttgggccttattttgttcatctgttggaaaaaagcatgccatattttaagttacaggctcattataagaataaaaaactcctttgaaagatggattgataaacacatttgtaccatcgatttctggttagtgctgtttaatctttatgattctagtgtcaaattctccccacaactctaatatagagtcaattcatacattcaagttaatggtagatggtagatagtatgcataaaaaatttgaggcatgaagttgtaaatgaaaattaggactaaatttaaatttaaatatacataaattttgtatttaaaactttcagtacagccatgtaccctataatgacattttggtaagtgacagactgcatatataagggtcctgaaagattataattctgtatgtttatggtaccttgtctcagttcagatttgtttagacacataaatacttgtggtatagttggctcctgtgttcagtacagtaacatgctgcacaggtttgtagcctgggagcaataggctatatatcatataacctaggtgtgtaggaggccataacatctaggtttgtgtaagtgatgtctgtgatgttcgcacaatgacagaattgcctaatagtgcatttcttagagcttatccccatcattaagtgatgcatgacctgtatattcaatataatataaatgtaaattggagcattatgtatatatgctgtagtgtagtaggcaacaattgggtagtgcttggatcacagaaatgtgccactttctgagaatgccctagtagatgtacacagcaggggcctcactggccatttttctgccatgtcatctcttggcccttttttatggagctctacaaatcactgcagcgtggaactggttcttgcccatcccgaggtttggatgttcagtttctcctgaagtctacagtatttgttttcaattgtatcccccttttttgcttaaactagacagaattggtgtttttgggcaaacactatttaaaccttttaaaaagggtctgggggtctgggtactgtggctcatgcctataattttggcattttgggaggctgaggtgggcagatctcttgaggccaggagtttgagaccagcctgggcaacatggcaataccctgtctctacacaacgtacaaaaacttagctgagtgtggtggtgtgcacttgtcgtcccagctacttgaggggctgaggtgggagaatcacttgagcctgggaggtcaagtctgcagtgagccatgaccgcaccactgcattccaacctgggcaacagagtgagactctgtctcaaaaaaaaaaaaaaaaaaaaaaaaaaaaggctatcatgggagtgcttaataaacattgctagcaatttcgaatcctattttacataaaagattatagtaatttttaaagtaaggtttttaaggcaagcaaaggaacatgtattgatttctgagtatattgcacatttaattacaacaaatgaaactggtcatcttgtgtttttatttttgttttcatctatctgctttccagactaattggggagcaagaattccttttcctttccctgtttcctttagatgattctgccccttcatcttcgctcctcatttctgtagcttgactttgttctgtagctgtgtgctgttccctgggtgcctgccaggagggcgcttccttctgcctattcctctctccattcattgactatctttaagtggcgttttttccttccctacctgtattaagattttctacttgcagactcttctcccatgttcacaggagctggtttttccttgttgtgcatggaagcacctttggttcatgtttaggatatgagcattgttgacaggcactgttaacaggtgaaaacatctcaaaaggatgcttgattaaaataagtattttgttgttcataagcctctttatttggctttggtaaactaggagcctaaggtaacctttcattccagttttttaagtttttgtggttatattatgcagtttttattatgcagtgcttatttcttatgacaaaatatgagtaggttaaattcataccatatcaaaatgtagtagtgaaagtctctacttttctgatcctcagccccctagttccccctgcttgaggctatcactgtttccagtttcatgagtatttgttcgctgatattttatgcatatacaactatatatgtctttccttgcaaccctttgacattatacagatggtagcatactcttagcttggaggctagtcccagcgcatttttcgcctatattgtgtcttagagatcatttcatattagcacacatgggtataccttgttacaaacatgcacacacagaaaataagctttaaagccgtctgctgtagtgcattggcattataacatagtgtcatgagtcgtagagctggattcaaatcctgaccctgccatttaagagcttgtgaccttgggcaagttgaatcacttgtctgtgtttcaggtgctcatttgtaaagcagagttaatctctctctcacaaggtttttgtaaggattagaggagataatgtatgtaaagtatttagcacagtgtcttgcttaataaatcatagctattattgtactcattaatttatcagatcaaatgaacccctaatgtgtttctccttctcaactgaaatacacagaaggcattacttattacttgtttcgtgaccttttgtcttaccttggttgtccttttcttccaattccatagtttatcttctctcctacttacctcctgaacttatccccaacaaatgttacatatttcttttactttttgagttttcttggcctgttgatgaatatattgacctagcatagcccttgccattgcattaggtaccatcattgttggttttagtactagaaaaactcaacaaagaaggaatattttcttggtgatgctccagagtgaatttaatattgacaatcaaatttattcaagtcactagacaggatgattccttttgtgattgggatttcagctgggatagaactgagatttggatacagatggtacctggcagacgggaataaatgtggggctgaaatgccacagaagcagttagcagtgtgggcctatctgggggtggcctgaggaaggacattcatgaggggggagtaggtggggatgggaaggacaaaaaaccgcattgttaaattaattggcatgacaactctggcagtggggcctcacggagaatgaatgatatgcagggtgtggtgtatgtatgtgtggaaaatagaaaaatgtggtgtgtagaaactggaagaactgtctccctgggttattttaacgttctgcttcagagtacaagcagtttagctgtgggaagcccccacccttttccacaggagagggatggctctcatttgacacaagctgtcatgcttgtaggagtcaggattgttgcacccagaaatgcttgtggagggtcttgtaaggggttgagtgcctgtaagagcatctgggggcttagaccggtggccctcaaggtattaattccttatcagtgtgttcccatctacacccatggctggtgtggcctaaccaagctggcttaccttttagaagtttctttttattatctcctcaagagtacatgctctggcttcttggcctggcaggctttcattacttacatgatacatatatgtactctttgataatcttatgtttttgtcccttgtaagtttctgcaattgtatactgcattgatgaaggagggtctgctctcctctcccagggtgtctagtgatggcctgcatgtctctggtctgtttattgccaactcaagtaccttttttgccattccatcgtgaaagaaatcaaaatatagcattttgaaatacatttgaaatgttctgtttaaggatttcactttagttatactgtttctactttatattacaaatctggtttcctcttccatttgcctatatctaacccattcttagtctttttttttttttttttgcatttgcttttctgaaaatttgagcattgaaagggagggcagcttgatcatggaccagggctttctgagaatgcgaaaaaatgaatttcaccttgccaaatagaattgcctggatgtggtggagggatatgatgaggcagaatcacaattcttctacacttttgaaattgttctccccaatttattccccctttcctcattctcttctgatgtatgggtttaggaagctccggatgactgtttcacacacgcactcccctctcattctctcctgcccgtccttcccaccgcacacatgcgctgaaggaggtgagcattctggagacctgagtctcatttccagatatctttgccatcgtttgcagttacagctttttttttctatttttttccccctatctcttgtaagttctcatattatacatactttgaactgtggagatagccacaagtaaaataaaagtatatgtttttatattctatggagtaagaactcatgttactatagtaacatgctgctctgtagcagtcagaattgtgtatttcagtgtcagagttccctgttaaaaaattagccttaatattgatttcctcctgctcccaccttggttggtatatgaaaaccctaaagatgaagcatttttaactaatttttgttctttacacataatcagaaatcaaactaaatccatctgtgatgttagcttatggtctttctagattttagccaaagatcttgtatattttaagcagttgccctgttttaatattaatcatggccatcccagaataagtcctgcttgacacagggcatttgttcaactagttatctttgttaaaaaagaaaataccataagaccagtcatattttgctgcatctagagtgagaccaaactttataatatagtgataagcttgaccaaaaaaatgtttaacaattttggtatgtttcaggaattggagaaattagtatgttggtactgtaaggaaaaatgtgggttaaaaaaaaaatccagctaggactcagcagtcttaatttaaaccttgtgcttgacaaaaattgaatgttgcctgtatactccagacacaatcgtgaagctcagtttctgtatttttcttctgaaatttaacttctgctaatataacataggatatgtggatgtcttgcaatcctaaaattttaagatatttcagggcttatcaactgaaggctcttgaaatgaaaactactacatgtattcatcatacgtgaaataaaatctttttgaaactaaaaatcctttaaaaaattcacaagcaagatgatactatagaatttcttttgacagattccttagaaacgtcaaaatcaaagtgaaaacaagttggaaaatcctctttgattttgctgggtcacttaatttgagttgatttcttcagagcacataacgtttcttaaagtacagtactaatgacagagtcccaggtggccagccttgtgagctgcgaactttgtcctgttgtactacctctggctctagagactcagcctaggaatgtgaattggtgagaatatgtcagaacctggcttcctattgtaggaactcagtgcacttatttggttgatactgagtcgctataaaaatcattgacatgaatgacaagttgtgtttttttccccaacagttaaagacattttacatacagtatgtgaagttactttccaaagaaacattcttcatgttttcgcaagtttttttttaaacctaatatttaatgcaatgaatgtgggttggtttctcttcttccttcttccttctcctcctcctcctccccctccctctcccctctccctcccatcccctcccccctccttcccctccctcccttccttccttccttctccttccttccttccttccttccttccttccttccttccttccttccttcctccttttctctctctctctctctctttctctctttgtttccattgtaaacatatttgcaggattcagaggtgaaactgtagcggaatgtatacacagaagctctgcttatacctttgttcccccagcctgtttgccctctccctctacaggtcatcatttttattagcttctttctaaagttttttttttttttcacttaggtgccacacagcatcgagtgaactattttaaagtgaacagttgagtagtgttgaatacatccagagtgctgtgtgatcaccacctctagttccgggacagtttcatcccccaccaaaggaagtcccatacgtattaagcagcccctaatgaccatccacccgtgttctgcttctatggatttatctattctgaatattttatatacaggaataagactttgtgtctggctgcttttgcctggtgtgatgtttgaggttcatctgggttgtgttttgtcattacatcatatctttttatgactgaataatattccattgtatgtatgtgccacagtttgtttatccattcatctgttaatggatatctgtgttgtttccaccttttggctattgtgaatagtgttgctgtgaacatgtatgtgtgtttgaacacctgttttctcttctttttggtatatgcctagaagttgcattactgggtcatatggcaatcctgtgtttcacttttcaaggaaccaccaaactctctcccacagtggaaatggaacaatttccaccaacaatgtagaagaattccagttggtcagattgttgcctacacttactttccttttttaaaaaaaattcagtggcattcagggatcttcataatctgagctttgttttcctttgcagtgtaatctcttcctggtttcacatgccactttcagaatactggattatggtaattgcactcttttgctcccttctcttcacctaatgtgttgtccccacctgcccttttcccccacccataagaccttgtctctgtctctgtcgcccaggctggggtgtggtggtgtgatcacagctcactacagcgtctacctcccaggttcaaacagtcctcccacctcagccttccaagtagctgggatcacaggtgtgtgccgccacacctggctcatttttgtttttgtttttgttttgccatgttgccgaggctcgtctcaaactcctggacccaagcaagctgcccatctcggcctcctagagtgctgaaattacaggcgtgaaccaatgcaccagaccaggttttgcccttttgtttgcaggtccctttaactgtgatgctgtctcctagcccccttcccccactcgaccgagggccaggcaaattccaactcatttgctgagtttcagtcttcaccaagtctgtgaacttcaaaagacgttattcattgttacattccctgcatccggcacagtacctgatgtctgatgggaacccaatacatgtttgagtgaatgaatatgttgtataattcttttttctttatcacgattgctgctggtgccgattgaatttccagagcttgctgtaaaagataggaagaaaatatgtggtaacattggccagtgtttgggccataagatgtgtagaggttctaaggaaaaatacacttccaaactcattcacattgctggtcatgttcagttcctgtggctgtaggactgaggctcctgttttcttgctggcagtcagctggggccacacactgcttctagaggtcaacttgaattccttttcgtgtgccccactccatcttcaaaccagcaatggtgtgtcaggtcctttgtatgctttgagtatttctgacttacgtttttagttggagaaactctgggttcatgtacctagatcaggtccaccttaattatttccctgccttcaggttaaatgtgctgtagaatatgacattgtcacagaagtgagatctcatctttagttacaggttccagagtatggggcagaacatttttgaattctgcctagcacagtgtttatagtttattgatctgtagataggttgggtaaaggttcttcttcagccagtaaaatgtcatcttctctgtcttttgattgcagggtttctattacctatgtccatttctttaagccgtttggtctcatattcctctgtgtgttacaagaattgtatcatgttatctatttcatgtagaagtaagcatgagagaaatgagtgtaaatgggctgttggccctcacagtaaaatctggtatctattctagggagatactcatgtttttctcctttttcacattgctgtcgtagggtcagattcatttttcatggtcatttttctggttctcttttagcatttgaaattgagtagattgttttgattgtaagaatgttttttaaaagtaaatttttattaaaatgtatatatggaaaggaagacaaatagtatattgcttgataaattttcacaaagagacatgcacatgtaattaatacccaaatcaaagcattagaatatttactagtaccctagaagccttacctactcaatagctcccttaaaggcagttttttgcttgcctgttaatttgatgaactttcagcctttgaaaagtcgttacaaaaagccgatgtgtaaaatgtttggaggataggataagaataggaggtggctcttggaagtttgtttgctcctgagtatgggacctagtgatcaaagatgaagtggaactagatactttatcttccctgtaataggaaatacactcccattgtataactgtaatttttactcataaaaatgggttttgcactcaaagcaaaagtaggctcttacttttactgttaaaatagaaactggaaaactgttctttagaaaagtcatcctaatgggttcaatttgaggtagttgctggtttttatatttttatttttttgaccagtgctttaagtttttctcctgtaattttattaaacctatgcccaggaaaaagtaaacggcaagatttcagaatctgaaagtttcttacgtttgaaagaaagtcctcccatgcttcatttttcctaacagaaggtaaactttccatgctgaacttgtctctatttttaacagaggacaagctttaggaaactgtattcaagccacatatagtgtggtagattctggtggtggagcagctattagttatgtttctctggaactgcatttatcatcactgttaccaaaagcatcctaggttccttgggaagaagatcttaaagttctctaccaaaccactttttttttttggtgatgcttcagtctcacaggtgatgcttaaaacacagattctgatgtggagatttgagatcttacaaccatagaccatatgttaaacattgactacacaaggattcgtgatctgagcattaatagcctgtttttttcctaattgcatgttttatagtaatcctaacctttaatatataagatcctaacctttatatttaacgtcttaacctattgctctgtatttctttaatgccatggattattgcttacagttataaatgaaataagtaattttactttatattttcattgatattcaacgaataccaatttaaggagagaaacatagatatacttttaaagaatttaagcgtggcacttaagattctttttattataataagcatgtgaagaagctctttttctgtaatcctagttcccaggggccaaaatgatgattaattacagacaataggtttataaaagtaaccgtttccatcatagaagtgtcataaaagattaaagggtgtatcaacaaaatgaaccagcttcctgtgtaaaattattaatattgctaaataatgtagccttatatctgttacaaaagtaccagaaaaattgctggataatgtgttacaaattttttacaaattacatagataatcctcagttctgttgaatttctctgacattctgctcaactagtttttcctgtgcagaaaaatcttaacaggttgatgttacaggaaaagtggcatgcttttagaaaccatgactaggctgcctgaatcaaacatcctcccctttgagaggcctaggaaagaaccatctcgcttggttgtatccagggtacactctcatagggataaagagccaaccaaataaaagggcagacatatacttagctgtacctatctatcctaatgtgtgtatatatagtgaagctattgtacaatatttcttaatgtaacttaataaggtagttagttttttagcctcctaatggcttagtgtttataaaaatgatactcgttcactgcaaattgtagagtatataaaagtgtagagaaagtagaaatcaacagaaatccttttccctcgagataaccgttgtgaacattttggtgaacatgtttctagaaatctctatggttatatacatatgtaaaagtgtacatatctaatgggatcaaattatatgctgttttgtattctctcagtccacaacttgccagttttcaaatctgtaaatgtagatatatattattttcaatggatgtatgctcttccactgtgagtcatagtttagtttactctgatatcactagacattgaagttgttttagttcttcattataaactatgctatgatgaatacagttgtctggtaattctgttagtttagggtaaatactttgaagtaggattgctggctcatacagtatgtcttgtttcccgccacagagctgccctttggaaaggtagtgttagtttacacatccactgagtcctcattgctacatcttctcaccaacactgctttctaaattaattatttcaattcatttattttttatttaattttttatcatggaaaatgtaaatacatgcaatggtagagtatgcatctatcactcagtttaagtaatttcaactcatggctaattttggttcatctacatcccacctgttttccttcttttcattttgtgaagcaagaggcttctcaggctgtcatttaacctgtgatacctcacttttatttacatctgtttattactgaaatgagtattttttaaatatacttactgggtacaaagtggttataaactttaatagtgagttaattgattttcttcctgtgggtttacaccaattgcaaaagtgtaatttagctcttaggttgaataatcttaagctgatttaatcttaagtcagatgtaaagataatgttcagttccagaaaggtaaccagactctgagctggttaggtagcagctgcagcgtttggtcctgggtgtgacatcttaagaagaatattgacaaatgagcatttccagaagagagtgaccagcatggtgatattagagaatagtgtcacacagggaatggttgaaggaaccaggtggggatcttcagtttagagaagacagaaatttgagggaagaggctgatgaatggagacagctatctgcagatttgtcatgtggaaggtttcagggataacaaggaagaagctgctaattaagtagcaataaattttatctcctctctggctgcttagcttttattgattttatttatatacagctgctggaagcaagcgactggttttgtgattaaaatgatgcttttgggtttctaggaaaccctgagatgatctttgtcaggttttacttcacatacccatctctccaaacagggatttagcgttgagatttaaagcggttttgccatataagaaaatatttttcagtagagaaaaataatattccaactgaaagctgtccagtataggcccagaatcccatatctgtagttccaaaataaaaaaaaaatcctgacagcagaatgtttcctaactcatttagaagcaaaacttgacctgaatgactgtgtctttatttatcctacttgatgtgaatattcatacatttctttgcagaaatagtaatgtgtttgattacggtatgcttttccataccccaggaatattatgtaatgctgtaattacccatcgaaaactcatgtctgaattcttaacacttctggcacagagggtgtgtatacctatagttgtcgttctgtcgtatgttgaattatatgcggtgtattttgataccctatcactatgcatgtgtaaaaagggaatgatagtgcttttcctgtttgtccctctggaggctgtgaaaattagattactatgtggagcatattcagaatagaactgcctaaaaataacgtgttactggtatggtattcttattctgtgtgtgtttaactttctgcccgaagataattgggaagaataatgtggaaatctgtagttgaaatattataactgttgaacaaagagatgtcttccagaggcaaaatgacaaatgatatttaaaaaatattttcactttatccaatctgattagtatattgtggtgttattttgaattatttgaaatgaagtaatatatcataaaacagaattaggcttattttaaggtctacacttatgagctcttacaatttgcttttagatatatatattgaagttacttgtaaatgatgatgatgatttcattttagatcatgctaacattctagttcagatgatctgggttgcttgtattagtgtggcaagacccaaacttcacacagaaaggaaaggcagtatgatttctaaaatatttacttatatatataaaaaaacttggttaaaatcaaacagcagaaaaatgtattacataaaagtctccttcccctaatccttgtactcaaagataactggtatgattttttttgtgtatttttttcataaaatctttttatgttagtatatatttcaaaaattcatacaaataggatgatgcgctctccatttcatccctcttttacttatgtgccttagaaatctttccatgaccacacacatagatctattctccttttagtgactgaagtattccacatggactatacagttcagttagttcaggtcatgggctgttaggttgtttggttgtcttttttgtttgttttaaagtaagtagaagtgatcatgcagtgaacaactttgtgcagtttgacatatttttctaagaaaatcaaaaggtagattcctagcatggaaatgtaaggaatcatttaaatatactgataatgctggattacccaaaccaaaggtctcatcaatgtagtcttttacgatgttcaccgatgccgtttatcccctctcttgctactgctagacattatttaagtaggtacgtctttaaatgcatttttcatttaaattaatttatattttgttaatgacaaattaaatttgaagaaaaggttatatatgtatgaggcatatcattttacattttgcagataatggttggtactcatttaagctcccaaaactcttggttctaaaccacgtccatgaggcactctttgatgactctggggaaaagcagattctttcctctcttctcattttgatctccttgggaggaaacaagctcctttttcacatacttttttgaaaacagctttattcaagatacaattcacctaccatataattcatctattgaaagtgtacaattcaatagtttttaggatatttagagttcagagttgtgcaactctcagtagtcaatttcagagtattttcttctccctaaaagaagcctcacccttcttagctataatcacgccacatcttcacaccctaccctaggggaaccattaatctactttgcgtctctatagatttgccttttctggacatttcatataagtagaatcatccgggatgtcatttttgactggctgctttaacttggtgtgctgttttccacactcatccattttgtggtatgtattactacagttggttctctgcattggtgcattctacatctggtgttcaaccacagattaagaatacttaaaaaactgcatctgtactgaacatatgcacacttatttttgtcattattccctaaccaatgcagtataacaactacttatatagcatttatactttattaggtattataagtaatctagcgatgacttaatatatgagagggtgtgcatagcttatatgcaaatactatgctgttttatatcagctacttgagcattcatggattttggtatgcataggaggtcctggaaccaatccgctatggataccaagtagatgtctatacttcattcctttttatggctaaatagtatttcattgtatgtatatgtcaccttttttttcccatttaccagttgattaacagatatttgggttattttcactttctggtgtctgtgaataatgctggcacatactgatttcatgtggacatatgttttcatttctcttgggtatgtacctacaggtggaattgctgggtcatatagtaactgtttaagcatttgatgaactgctagtttcctaagtggctgcattagtttacatttccaataccagtgtgtgagggttccaatttctaacacttattttccttttttaaaataatcatctcctgtggtttaaatgtgttccctaaattttatgtgttggaaacttcaccctcaaattcatatgttgattggaggtgggcctgtgggaggtaattaggattagataaaggtcatcagggtgaggcctccatgatgagactgttggctttgtaagaagagaaagagatttgcactgacatgcatgtgtttgcattgttttgtcatgtgatgcgtcttgccatgtcatgatacagcaggaaggccctcaccagatgccagtgccatggtcttggacttcatagcctccagaaccatgagctatgtcaacttttctttatgaattacccagtctagggctaggcacggtgactcatgcctgcaatctcaacactttgggaggccaaggcaagaagactgcttgagaacaggaattcgagacaatgtgggcaacataacaaaaccatttcgcttaaaaaaaaaaaaaaaaaaaaaccaggtgtggtggtgtacctgtagtcctatctacttggaaggctgagttgggaggattgcttgagtccaggaggctgcagtaaactttgatcctgtcattgcactccagcctggatgacagagtaagaccctgtctcttaaaaaacataaaaatagggctggttgcagtggctcacgtctgtaatcctgcactttgggaggccaaggcaggtggatcacgaggtcaggagtttgagactagtctggccaacatggtgaaaccccgtctctactaaaaatacaaaaattagctgggtgtggtggtgtgcgcctgtaatcctagctacttgggaggctgaggcaggagaatcacttgaatctgggaggcagagattgcagtgagccgagattgcaccactgcactccagtctggcaacaaagcgagactctgtctgaaaaaaagaaaacaaaaaacaaaacacccagtctatggtgttctgttacagcaacagaatatagacaagtgcatgatcctaataagtgtgaagtggtattttgtggtttttacttgtacttcctcaatggctaataatgttgagcatcttttcatgtgcgtattgtccatttgcatatcttctttggggaaatacatatcagatcctttgcccgttttttacattagttgtcttactgagttgtaataattctttttatattagatataagtgctttatcaggtatgattttcaatctgtgggtcctcttttcactttcttgatggcattcattgaagtgcaaaagcgtttaattctgatgtccactttatcttttgttgtgcttttggtgtcatatctgaacacaagtctttaaaggatgaatttgcttggtgaaacacctttcctttggataccaggttcataagattggacacagtcaacatttttttttttgatctcaatcacttattccttgaagataatctcagatgcagcttattttaaggcagtcccaattagttgactttcagatgtgttatttggaaatacttttaaaggtattttgataagaaaatttaagttttacaataaaatgtaaccttgcaatgtagctttgcattttatggtaaacattagttactgcttactttacaggtactaaaaatcaactacttcaatttcagaatgtaactttctcatgccttattttatttcgaccagtattaagcctctttatgcttagaagatggtgttgaatctgtttcaggttaaaaaatactttattcaaactattattttcttaaaagttaatatgtctaaagtttttgaaagacactgatcactgagatgtttggagatttaaactggtttatttttggttatccatggaaaactttaaaaaatttctttattgaattatagttttaagtctccttattttattctcgatgattaatgtacagggcgtggcttacttataagtgtgactaaagttgtgcaaattaatcctagcagggctccatcctttaatgtcagtgccgtcagttgttctccccttattcctattattctggcattatatcttatctgtatgtaaattcttattctgtgggtgaaaagggatatggttcaacaggatccaagaacttaaaaattgccctttttcacatttctcataagtagtaagtctcctaaagcgaagtcagagtcattataaaggcatgataatggagtctgttatctatttggaaaaacaacttttattgccatttataataaatgtaaatggcctgccatttattttagaattactctgtttctaggccctagaaaggctctgcattttataattaaagttagtagaggctagaagaacttataggaatgtcataatgtgctgtaggggacagtgatacttttaaaggttctgacattcagccagtaaggtgcttctagttccagataacttcttttccccccaggaatagatacagaaaatatttttggtaaatctgccaagttttttatgtgattctcattatgttaaattttattatcagtgcctaaataatgctaacattttaagttaaacagttattcagcttaccactttgacattaccactgattagaattgaaggctaagttgagcctggggaacgagcctctttgtccagaaaagggctcttagatttttccctgtcagtgtattgtaaccttttataagggcagcgccaagaaaggagaagctgctacttggggcattgtgtttgactttggtattctcacaggtatgctgtctaggaaagagttcaggtctcctgcttaagaaattgggaactaggctgcttcctgtggttctgttgctttgtcgggggagggagggtacctgatttctactgaaggccaaaatgcagagtcaatatggccggttattggcaaaaattatgatatttagaaacttttggaatgtctgcaatgttttctagacattctagggaggtcactggtgtttggaaagtacatacaaatggtgtatgaaaggagtgtgccattttctgcagaggtgttcgttacatttcataaccttatgttgccatttaatgaggtcaaagaggtttcttgactgtgactatggaatgcttatcttttgttctgtcttgatctcctcctgtctgtgtctctcattatctctgactacttgtatgttggcagtggctttatttcctttcacactcagcctggattccaggctcatctctaactcctacatcagaaccctgaactggcttgtctgttttgtaatctgccctaccatgcatacccctaacctagcacaaacgccctacccttcccttctcttgtacccatgtggctcagcacttctggataaattagaacaactttgacgatggtattggtcagggttcgattatcgaggacagactctaattcttcctactttaagcagaaagcagtttattacagggaattaaatttcttggtgaattgttgagggtacttagaaacgctcctagcaggttgtgctagagtataattcccaaggctgccctgtggaactggactgccagggtggccagcatcctagcccaggcatggggctgctgatttggctgttgctgctccactgctggccccagaaccacaccaccttggccgctgtccacaagagtaaagtggctacatcacacttagtttctctccccacttagttcagtttcattcttaacccagttggaccataccatttgtgttttgcatggttcatgtttatcatgatctgaaggaacctaaatctagagcagaaccccaatgtggtttttcagctttccagactctgcagagctagaaggtgggagtagattgaagtgagtcaatctgcagtattttccacatttatggtttccgagtatagctggctcttcaagattgttttgtagtcctttcacctttccttgataggttgacttgtttgctgatgaaagcagcagttctcattctacgctggcctctttcattctcattagatggtggagcctacgcttgagagaagaagctgtcgggtacgaactccacttaattgtcctcctgttcttccctgccgtccctttcaaatgaccacaggtagctgtcatagccccgtagagagtgtgagaaagcacaggcaggagtcagcaaggttgctgggaggactgaggctctcggaggtggatcctggaggtgagagggccaggtgtgaggacaggagcacgttccagaggccccacgacagcctcgcccagcacatggcaccattcttcacttacaatccagggcactctactttcctgtcttgctggtggcagctcattctgttcccttcgttgaatcttcccttcctatcctcaggttcagtccttattctgttcttgacttctctttgtggacaatctccttagtttatctctagcttcaacctttcccagaagtctagaggtatatttccaatggtcggtcatcttagatagctcataggcttctcacatctaatatgtttgaaaccactcttgatttttcttttttttcaaatctctctcacttagtgtctcccattttaataagtggctttatcatttacccagtaactcaggccccaaatcttggagttatccttcattttttttcttctctaatttatcaccctgaatcccattagtaaattctgttttctctgcttttaaaacataccctgaaaccagtcacttataatcagccttattgctgccattccaggccaccatcatcactaataagccttataaatggtggccctaacttttaacttctgtatccagttgccagagtgacataaacctaaatcatgtctttccactgctcacttagattataaatactattgcacttagaatacaatttaaaatccttgctgtggcctacaaggttctgtgtggatggtcccagttatctttctttatttaccccctaagcattatccacctggcttaccaagttacttccaagctgtctcctgattgttctctatttaaaacaactgctttattaacttactgggataagatacataatggtacttatcttttttttttttttctgttccccagtagactataagcttcataggtaggaatgttattttgcttcttgtgttatcttttcttcacctggtacatagtaggtgctcaaatatttgccaaatggaagatggggacagggaaattattctacaggtcttgtcttaattggaagattgaaggataagagggtctttgtggagaaagtagtctgtaagaaatagtagtaaaatatgggactgatcactactgccaggaagaggaaagtaagcactagaactttcaaattcacagaagcaaaaatgaaatgaatagtaatccaaccagaccagtgggagtcaggaaaggaaaagtagaaactgcaagatagaaaagaaagatgaagaaatgggaatgggccagagatttactgtcttaccaaggtggagcagccccatttctctctaccctcttaggactcaaaatccctggacttcatataacaaagaagcataggaagatgctgaaaggtggagagaagactgtggccactctagagtcctggggacttgagaaatgacaagggtgtcagttcccctccttactatctcccacatgtctagtacagggcactgcagaagcctccatccctgaaccaccagtaggcacagacagcaaaactctgagaagagcctgttccccatagccagaggacaggggaagggagggtggtctaacaaaacagagcttttgtcagtactcactctgctccagctaaaccaaggaaactgccctcctcccttcccaggcttcgagagcaggcagcatgcttcggttccccacccagaggctgaaggcatgcctgagcagagagttaatctttcatatcctgcctggcagaagcaggtggtacttcaattcccctgtcaggtggtgctgacagcgcctagtggggagctgatcttccaccctctgcctggtaggagcaggtgatgctctgacttctctgccagggtagtgtcagcaaggcccaggttagggccatatccagcccccaccagccacaatgaggtggtgctagcagggggctaattaccattacacttgacctcttccatccccatcatcccctggtggggaggtgtgagcctccacacccactggtggcaaatgaggtatggaggagcggagcatgctggcactccccacctccccgcccctcctttggtataaatagggcccccgggggtcctgaacttctgctcctggatgcagcaacaaactggcatggcttagcccttggctttcccttccctgtggtagcttggcccagagggtagctgatcttacacagaggcaacagaaatggtgagttggagccacactttggctgggaaagtgtcagtgagctgaactctcaccccatctgtctgcaacaaggcaatgtgagtcatcaccccacttttgtcagggtgatggtggggagtggggggctagtgggtaactgaatgtgcatacccactcatccctggtattaatgcctttttagcagggaagctgcccactaaaagattaaatttgatctggggtctcttaatatcaaaaacatataggatacaattcataccaatttatacaattctacagatcactcataccaagatccaggaatatcacctatgaatgagaaaggaccatcagcaggtgctaactgatttatctgacaaggatttgaaagctgctatgataaaatgtttcaacaagctattacaaattcttttgaaacaaaacattagaaattctcagccaagaaataaaaataatttattaaaaaccaaaaagaaatgatagaactgaaaaataatgatagtttaaaaatactgaatgggctcaatagagtggcaatggcaggctgagaatcagtgaacttgaagacagaaaattagaatctgcccaatgtgaaaaaaatagactggaaaaaaaaagtctcatagacctctggagtgatgataaaagagataacacttgtgttgttgcagtttcagaaggaaagaatagagtgggaccaaaaaaaaaaaatctgaagaaataatctgactataatttctcaaatttggtgaaagacagaaagctgtagatctaagaagctgagtgagccccagacaggatcaacccaaaggaatctgtgccaagacacatcctgattaaacttgtgcaaggcagatacaggaaagctactgaaagtagctggagtttaacaatgtgtaatttgtaggggaaaaccagtccaaatgagaggagccttctcatctggaatgatggtggccagaagaaaagcagcacaacatttttcaagtactgaaagaaacaaccattaaccaccaattctatatgcaacaaaaatgtctttcaggaatgaggggaaaaggaaaactttcttgcatgaaggaaaacaagttgtggttggttaccaagcatacccttaaaaactaggtaaaagttctttaaatgaatggaaacgaaaacataaggctctgaatttcagaaaggactggaatgggcaaatataggggcacatgtaatagactttttatgagttatatttggttgaagcaaaattttaatgtaatatgatgtagtaaatatatgccgcggaaatatttaagacatgcttaaaaagtggggaagggccttttggctggaaccaaccatcttctgttaatttgccaaaatgatgaacgacaaagagaaaagggagaggcacctggtatgttctctaggccttttagaaaacatggacttgttcttttggccacatacctgcaaatctataagaaagatgatattggagacatcaagggaatgggtactgttcagaaaggaagccccacaagtgttaccatggcaaaactgcaagagtctacgatgttactcagcatgctgttggcattgtaaacaaacaaggtcagggcacgactcttgccaagagaactaatgtgcgtgttgagcacattaagcactcttaagagccaagatagcttcctgaaacatgtgaaggaaaatgatcagaaaaagaaggaagccaaagagaaatgtaccagggttcagctgaagagccagcctgttcccagagaagcacactttgtgagaagcagtggagaggaacctgagctgctggggtgtctctcctatgaatccatggcatgataggtgttaaaaacaaacaaacaaacaaacaaaaaaaaacaccaaaacaagaaaatactctggactgtgtttaaagaaaaaaaaaagtggggagagtaaaggcaacttacatggaagcatggaagcctgtttttcctattttgcttgtgctggtaaaaatgttgataccggtagagtgtgataagttacatatgcttactgtagtccttagagcagccattatgaaaactggtatactcgagcactatgaataaatgaaggtggaattattaaaaaattgacataatccacaggaagaaaggagaaacagaagaaacaaaataacagaaataattaaatggcaggcttaggcttgtcatactaataattggcttaaatatagatgatctgaatacaccaattaaaggatagagattggcacagtggttaagaaaacatccaaaactgtgttgttcaagaaattctcttaaaccaatgacacaggtaggttgaaagtaaaggatggaaaaagatatgccatacaaacatgaatttaaacaagagtggccatattaacattcaaaaataatttcagaataaattaataaagacagaggcataaggatcaaataatgaacacattaggaagacatgatgatcctaaatatgtacacaccaaacagaacctcaagatacatgaagcaaaaactgagctgaaaggagaaataaatttaacaaatactatatacatataaataaatgtaataaataactgaagtcttaaacaccatattcttagcaattagtaaaactatacaccaaatcagcaagaatataggacttacacaattgaccaacagaatctgacatttagaacaatttacccgaaacaatagaataccctactttttaagtgcccatgggacatcatagacattattctgggctataaaataaaaaacgtaaaaggattgaaatcctacagaatttgttctgtggcaataatggaatcaaactaaaaatagtaaaggcaacaggaaaatttctaaataacacatttataaataattcatacgtcagtctcaaaggaaaatattaaacataaaaatgaaaatatgttattaaatatgtgggatgtagcttaaagcagtcccaagagggaaatttatagcactgttataaattaagttgaaaagtggaaaggtctcaagtcaatttaagctcctacctcaagaaactagaaaagagcaaaacaagcctaagcaagcagaacgaagagcagaagtcagtgaaattgaaaagaggaaaaagaaaaatcataaaaatcataaaaagttatttctttgaaaagatcaatgaaatttagcaagactgacacagataaaaaggaataagacccaaatcagtgaacaggaatgaaatagaggatatcactacagaggctgcagccattgaaaggataattaggaaatcccacagataactttgtgctcataaatttgacaatgtagaggaaatatctttagttttaattagctttttattttagtttttctcaaaaactaaaacttaataaaactcaaccaagacaaaatagacaatcagaatgtaggcatacctcagagatgtggcggatttggtttcagactactgcaataaaccaaatatggcaataaaaggagtcacagaaagtggtttcccagtgtatatatataaaagttacatttactctatgaagtgcaataacattttgtctaaaaatacacacagtaattgttgctagaaaatgctgacacaaagtgagcacatgctgttggaaaaatggtgctgatagacttgctgaaagcagcgttgtcactaatcttcaatttgtaaaaaaacaagtaaaattaaaaaaattggccaggtatggtggctcacgcctgtaatcccagcactttgggaggccaaggtgggtggctcacgagctcaggagatcgagaccatcctggctaacacggtgaaaccccgtctctactaaaaataccaaaaaaatagcggggcatggtggcaggcgcctgtagtcccagctactcaggaggctgaggcaggagaatggcatgaacctgggaggtggagcttgcagtgagctgagattggaccactgcactccctggagcctgggaaacagagcaagaccccgtctcaaaaaaaaaaaaaaaatcatctatgaagcacaataaagtgcaataaaacaaggtatactgtaatgttaaagccattaaagaaattgaattcttaattgaaatgctcccttaaaaaagaaaaaatctctgggtccagatggtttcactggacaatttaccaacatttaaagaagaattaacaccacttttattcagtctcttctagaaaacaggagagaagacctagaaaacaggagagaagacctacaaagtcattttgtgagtctagtattaccctgacagcaaaatcagagacagcaaaaaagaaactccacagttcagtatcgctcatgaacttaaaggcaatgatcctcaagaaaatattagcaaatcaaatagagtaattaataaaaaatatttaacatgaccaaatgagatttatgccagccatgcaagactggttcaacgttcgaaaatctatgccacccaccatatcaacagaccaaagaaaaatcagcatctatcagttgacctataaaaagcatctgacaaaatccaacattcattcatgattaaaaattcagaaaactagcaataaagaactttctcaactaaagagcatctaacaaaagccttctccagctaagaccatacttcatgatgaaagatggaatgtctttcctctcaggttgggaacaaggccaggatgttcagtcttacctttgctgtccaaaacagtagtactaaaagatatccagaccaaaaaggaggagcaaaacagtcccagtttacggattacatcattgtttatcctaagaaatctagaaaaaaaacttcttgaactgaggagttcaacatagttgctgcatacaggatcaacacaaaaaccatgtttctataccctaacaaaaaatatgcagaaactgaaattaaaaacacaatgccatttatgttctaaaaattgtgaaaaagatacaaacttcaacatgtgtaggatatttgtgctgaaaattacaaaactgatgaaacaaatcagaggacccaaatgttgccacaaaccatattgacatactggaatattcaacacggtaaatgtgtcagttctccctgaattatcgtagcttttatgcagttcctatataaaatcccagcaaagatttttggtagatacataaaaaggttattgaaaaacctgtatggaaaggcataggccccagaataactaaaacgatctagtaaaagaataaagcagttggaatcactctactgatattaaagctttcccttatagtgatagtaatcaagatacacagatcaatgcggtggaacagagaactaaaaaaatacataaatatgccaaattaatttttgacaaaggtgaaaaagcaattcactgatagattattcttctcaacaaatggtgttggagcagaaattggacatccatagacgaaatgatcaaccttgatctaaattttatattttatacaaaattaactcaaaatagattatggacataaatgtaaaattgtaaaactcttaggcaaaaaaggagaaagttagccaggtgcggtggctcatgcctgtaatcccagaactttgggaggccgaagtgggtggatcacctgaggtcgggagtttgagatcagcctgaccgacatggagaaacaccgtctctactaaaaatacaaaatcagccaggtgtggtggcacatgcctgtaatcccagttactcaggaggctgaggcaggagactcgcttgaacccaggaggtggaggttgcggtgagccgagatcgcatcgttgcactccagcctaggcaacaagagcgaaactccatctcaaaaaaaagaaaaaaaaaaggaagtcttcagaatccagaactaagcaataagttcttagtctttacaccaaaatcacaatccataaaagaaaaacttggtaagttagaaccagttaaagactttttctccatgaaagagcatattaagaggatggaaagacaaggtacatactagtagaaaatattttcatctgtctgccaagagactaatacctagaatatgtaaagaactttcaaaattcaataggaaaaaacaatccagttggaaaatggacaaaagacatcaacagacttttcaccaaagaggatatttaagtggcaaataatcacagaaaaagacatacattcagtattactagccattagggaaatggaaattaaagccatagggagaaaacttctgctaaatggctgaaaaaaaaaaaaaagcaccaaatgttggtgaagatgcagagaaacattgctcatacattgctagtgggaatgtaaaatggtacagccactctagaaaacagtttggcggtttcttataaaactaaacgtagaactatgatacaacttggcaagtgtactcttggatagttatctcagagaaatgaacacataatcatgcaaaaacctgtacaccaatgcttagagaagctttatttataataaatacccctacacaggaaacagcccagatgtccttcagtgaacgcattattgaaccacagtacttctgtatcatgattacttctcacaataaaaagggccaaagtattgatgcacctactgtgaatctccacatcgagtgataaaaagcctattctaaaaggttatatgttgtataattccattgatgtaatatttatgaaatgacaaaattctagaactggattagtggcttccagtggctaaagagcagaagagagtaggacggacatggatgtggctaatgaaagagtgacatgtgggatccttgtggtggtggaaatactctatcttggctgtatcgatgtcaataatctgtatgtggtattgcactagctgttcaaagtgtcattgttgtgggaaacttggtcaagggtgaatgggatctctgtagtatttcttacaactgcttgtgaatctgtaattatctcttaataaaaagttaaatatgaatggactgacttctattagaagacaagattggaaagtgccttaaaatacaggtgataacaagtaactcttcaattgttaaaggggaagatgaaagtgaagagatgggcaaaaagataccatacaaacaaaaaacagaatggcagtgttgatatcagatcagttgagactaacagttgaaagcagtaaacatattacggacatattattgataaaagacatttatgaagaggataaactgtgaaggtgtacagacactaaaccatagttgctaaacacatacaaccaaaaaaaaaaaaaaaaaactagaaatgcatgtatattttcactaagtttagttagatcaaacaaagcaataaaaggaatattttgtaccaaagcctatggacacagtgaaaactgtgtgcaggggaaaaaatctacagaattaaatgtcttcaggattagagaatacaaagtaaaaagtgaacaatgaaactccctacatgttcaattttaaaaaatgttttaaaaatggtggtaaaatatatcctaatttttcatctgaatcattaagtatacagttcagtagcatcaaatacgttcacattgtcgtgcatctagtctccacagctacttttatcttggaaagctgaagctctgtacctagctcaggatccaattttttttctcgttagttgtataagaaaattccgacttacttaagtagtggcagttattagcttttgagaacagtttctcttgcagtttcaagatgtgctttgcttatgttgatatggaagcttaaaagaagaattgtagacagtttatttccaggctgaataaaaatgtgacagttgctcttgttatcataaatagaagataccccaaaatttgcaacaaatgttaaaactgcattaccattctcagaataggtggatatcgtgttcttcttcgttgttgctggactggacgtaatggcatgctgatagcacgtttcaatcagatgggcctgagccctgtctagtgtataatttaccttttcatatatactgcaggagtgtccctggtagtaagttctgagagaatgaacgtaaaagttcagcagtcctaaattcagaaaatgatgagtggtgagcctttgtagttaatgacatgattactgccagtcttactgttgtacagtaataacaagagatgcttcatttccaggtccacacaagcacaaattgacctaccacacagggtagtgctttggggacaacttatgtaaaaatctgaatagtacccatctgattatgactgttgtgctttattacagattttaaaacatattgcaagaagttaagcgtttatagaagtctttgaagtcttgttgtagaacttcgggtctccacggaatgtggtttgatcactgctgcattgaagtacacagagggcatgttattaggaactgcattttggatttggaggattttattttcagataacttacggattttatagtgaaaatgcttatgctgatacctatttcctggtttctctgggacctgacttcttccagataaataatatcttcaaaagaatacattgaaaaaagatattgggacatgacatatgttaggaaacaaaaagagactgaactaaccttttaatataaacgtagtatgtcagcaaaccaaagtagctgtcattaagagatgagaatttcctgaaaaaaattacgtaaaatcctactcagtgatattaacacattaaatatatttaacttagacattcttacaataagcatgatttgcaatgccattttatttaaatggcagagaaaccccaccattcaataacatgagttatctttttttccaggaaattatttctgatttgaagatgggagtatagtaacatatcagggcttgtaacatgttttcagaaacccaaattccaggatggtggcacggctgaaaagactcctcagcgttatctgttttcccaggcgatgccttgccgtctctttcctgtttcagtgcttctctagagtattgcctcctcagtagtaaataatgttgttccatgaaatttgagatttttcatattgaatagcttctcgcagtaatgtttgatcctttatgatgcaggtcaccccatctagatgacacagcttgggctgccgtgacattggtagtcaggcgttcagtctgttggaattgcagtgtcatcacccactgcagttattcggttcttgttttctgtcttttaagcataataattaaaacagttcttttagaataaccccattgttagatgtttctggcacttgtactcctggataaaatgtttttgggtctaatttttaagatttagagtctcagtttttccacattgcaacttgtgatactgcatcctcttctgcttaaaatctttcagggaggttcctactgtcttaagaataaatttcagactcctgtgcatgcacaaatgctgctcataataaagctgattgtgccctgcatgtgggcaccagcgagaagaggagtcctgccagcttgtctgcagctctggggctggtttcggtgggtggggacctttccccttcactgagaggtgtcacctgggctagtggagctcctgtgagcctccgtgcaaggctgttcatctagcttcactttcttcctaggcttgtctctccttcctgccagcactacaacgtacgtatggtcctgatcgatgaagctacttcagattccacaagtgtgctgtgctttctggtgcccttgtggtaataacaatagagttaacatttatttatttttaatttttttaatagtcaaggtctcactctgtcacccaggctggagctcagtgatgtgatcatgactcaactgcagtctccaactcgtgctcaggcagtcctcctaccttagccttctgcacccccacacctggctaatttagtttctttttttttttttggtgtgtgtgtgtatgtgtgtttgtgtgtgtgtgtatatatgtatacatatatatatacacgtatatatatgtgtgtgtgtatatatgtatatatgtatacatatatatgtatgtgtgtgtgtgtgtgtatatatatatatatatatattttttttttttttttttttttttggtatagcagtgttttgctatgttgcccaggctggtctcgaactcctgggctcaagtgatcctcctgattctgcctcccaaagtgctagaattataggcatgagctactgcacccagccctgagagaattatttattctcctccttctctgctaaactaattggagagagtttcacttcatacaccaaagtctgcagttaaattcttgctgttccctgaaagactttgcatcttcgtgcttctgttggttgcccatgccattccctctgcttgctttcactgcctcttgcatccagacgttagccggttaagtggagttgtacttgatgccacttcttccaagaactcttctccaggtgcacaaaccagatttttttttatattcttttagcaattttgtagtactctgacaacacttggcacatatcttcttatactcttttgtatatggagcagtatttttataggtgaaagagtctaattttgcattattagtgtatatatgatatgttggataccagttggagatctggtgatgtcataaagctgttggtcttactatgcctttcccagaagtacctgatgaagttggaacaaaataacttttcacctattctctgattactacagtcaaggctccagaaccctagccattgggctcaaatgtgccgttgaaggtgattttctgttcctagatattttcaacctccctgtttcatttctgaccaatttttagggccagaggctaatccactagaacaatatttccctgtggcatggtttttaattttgttctgaatttagtttatattcctaagtggctttacaagttttttctccccatgccctcagaggaagttatgttcttctgaaccttctgggtaccattttagtaaattaagaattcagttcactgaatgctacccctgtggcctgaaagagttaatacaagtttcttaagtactttattaattctcagggaataatttatgcactagagcgtggcttagtatcgagccagttacaaacacattaaatatgtttttttttttttccttttgtgtagtaagtctctgaaaataagtggaggttcactttaagtgtaagtattttgcttcctaagtacttaaatatgtataattccacaatgagagaaggagtattataacagaggatgaggtggattcaggtcctagctcagccctgcacttctgtgaggccttggtgtgtttacctccctaaatgtctctcacctctaaagtggggacgatgtttacatcacagacagcaaagctcaatgatgatgcacttaggttttaatgcatagcccaggcttactgcttgggtttgattcttggcttcactacttgataactgtgtgatccgaggcaattttattaccctctctgactcagctttttccactgtaagctggaataatgctagtacctgactcacagttgttacgaaggtaagtgtgcagtaaatgtgagccattcatatacatcatggactactatgcagccataaaaaggaacaaaatcatgtcatttgtagcaaggtgggtgcagctggaggttgttagtgaattaacacaggagcagaaaaccgaaaacaacatgttctcgtaagggagaactaaacatcgagtgcatatggacataaagatgggaacagtagacacttgagactactagagcgggagggaggaagacgcagggcggtgaaaacctacctgttgggtactatgcccactacctgggctatgggctcgtctgcaccccaaacctcagcatcatttagtatccccatgtaacctgtgtatgtacccccaaatctgaaataaaagttgaaattgtttttcaaaaagtgagctgttattttttttaaatactcatttggaggactttctgagctgatcaagtgaaataaaataaaaagtgccaagtactatgcctggaacatggcagcaaacagtgaatagaggatgacttttgcttttattaactacttaaggtttatctatagcaagttccagtcttaagatgcacatgtgaaaagctgcctgtcacatgaaagagtttgatgccatgtagcttgtcatgttgtcagactctgtccctggagtgtgcccctcacgtttttgtgcatgtcactgtggcatttatgtgactggtctgcgcttctttctcctttttacccctttggctgcaggatgttgaagtgcacttcagttttgtcgttctcatttcccttctggattcttgctcctctcctacttctgctgcctccttcctcagtcccccattgccttcagctgccctgtggttgcagtttaaaaaaaaacaacaaaaaaaacacaacaaaacaaacacacaacagcctatttagatgtatacctttgactttatgagggctgtggttttgtgggaagagcagggtctcacccttattagactgtggttcataatcacttaaagagaacgtcattcttggagttactcatctgaaaaagaagcctgctcctccaactggaaggggaatggggctggggagggagggggttactgttggatggaactgtgcttggctattggacctgagtgactgaacacagtgtccatgaaggagctggctaggcatgtgttctgcggggaccagccctgtgagggcagaggactaagaagcgaaggatatgggcaaggaaactgtggaagtcatacctgcctttttgggccagagtacatgtatcttttatttttttttgagacgtagtctggctcggtcgcccaggctgcagtgcagtggtaagatctcggctcactgcaagctccacctcccgggttcacgcccttctcctgcctcagcctcccgagtggctgggcctacaggcacctgccaccacgcctggttaatttttttttgtatttttagtagagacggggtttcaccgtgttagccaggatggtctcgatctcctgacctcattatctgcccgcctcggcctcccaaagtgctgggattacaggcatgagccaccgtgcccggcctaagagtacatgtatcttaagaccacatcctggattggtagatacagaaggtttactccttgggcagtgctggactcttgatgaagtagcaggtagaggatgaagtttggggactttgtgcctctcacatttatgcctgctttttaatgtagcccaataacaaaaggtcatgctattggtgatgggtgggtaaggtacctactaacagtaagtttagcttagggagaggtaagccattttaagtctatcagtatataatggatcacagaaggagagagtgggagacactcagtctatcagaaaacataggatggatgtgccacagaggaagaagttgtcacttaacaatgagtgtggaaaaaaacaaagtttatcagtgtctgtgtgggcgttatttatttggggacagcatcctaaggcaggcatattcccacagtggaaatggatgtggtgtgatgccatgaacttgtgaagcaagtgagtccctttgttgtgattccaaatttactcagcacataactgattattatctgctccccagtgtagttgtagtgggacagattacattgcccagaagagttcagtattcagtcttcttggtggttattttgttgtaaattaataatactgatagtatgtcattttgctttttataattgattgtctttaactttgccctgaggcatttttcctaatcaactctagaccatgatagagcctttgggccacaagactaacagtcttaccttgaaccaccagtcagtgaggtgtttgggaaaaccttttcctggtgatgtctcatcttttccttctacagtcaccaatgtcatatttactgtgttaagatgctaggctttgtactggcttgtttacttctcacgatttatcttgcagtatgatagtttgtgtgacactgaaaaaaattagtaggactgttaaaatagttttttccccccattaaaagtagaatgacaccgttttgcttctgaagaatttggctttaactggtttatattttgagctgggtattaaaggagaattatggtagggtaaacacaattagtgacatctggttgccccaagaatcaataatatctgatactacatacataaatagatatctatgttgtgataatatatcttagtttcactgggtaaaactagaagaataaaaaatttgaaaacagcttggttactgactaagctgcagcagttctgagagcctactgttgtcatttttaatgggcagccttgtacttccatagattggttaatcttaaaggccagatggtagttgtattgtaatttcataaagattttatgtcctatgttttgctttcaactagaagcatgagaatttaggaaagttatattgagacatataaataataaaaattggtgaatcattttacctaacaatttattgatattactcaacacaaggagaaaaattagaaaatggaccttaacaccactgtctactatgaagacagtatagaggaggcaggaaaaacagaaagcacacaataacatgatagctataaattcaagtgtcagtaattacaataaatgtaaatagactagaggattctgctaaaagacacgtcagattggattaaaaacatctgagatactaggtttacaagaagcatatctaaaaacaaagatacagaaggcaaaataatggaaaattttatttcaggctcactttaagcaaaataaagctggtataacatgttgatatcagacaacatagaaatcaaggcaaaaggcattagagatgaagaggatcactgcacagtggtaaaaggttcagttcagatataggtacatattatataaagcaaaaatatacagaaacaagaaaaatagctgaatgcacaatcctagtgggaagttaacatacctttctgaatagtacaacttgcagacagaaatcttaggatatggaagacttaaagaacatgatcaatgaacaaatctgacctcatggacattcatagaatgttacagttcctgtataatccattcttttcaagcacatggagcatctgacattgattacatataggaatataaagcaagtattgataaatttcaaatgattgaaatcatgtagagtatttttcttacggaattatagaaggaatcaaccaaaagataacaggaaaatccttgtatgtcaataaattaagaagtatatttcttataatgtataatatataattttataaatatataaatatatatttataaaagtttcatttaaaaagttttacaaaatggaaaaatctgtcacttaaatacaaaatcactgtacttctgaccctactaaatgtaaaaattgtcaggatttgggaggttttttttttgatgtccaaatacttgatacacgttccagagatccccaatatttttgtgaattcttcttaggaggctagtgatcatgtatgtgggattaggaaagtaattgtttgagctaaatgggggaagagatcattcctgctggtagcagggagggtgtgccacgacgagagatctgtggatttactgaaaacacgagatttacatccagagcttagttcacaggctgtggctcctgtttttattcatttagaggctgatagaccagctgtgcctgtagttacgtgttctttggccagacacctaaggaaatttgaggctcagacaagctgaagtagatatttctgtttccatgttgaataacagagccactcatgggctgtcacagatacactgtttggggttttaccattccttcccatttccattcctgaaggaaaaagagaagagatttttctttttttttcagattattactgtgttggtgacctagggaaaccctttttttttctcttctcttttcacaaagttctgaggagcatgaaaaaattgaggtattcacagtgtctggggaggaaatgagttctgtcctgtattttccgaagagtgggaatctaaatcggaacaggcaccaggttgaagaaataatttgtcacatcatggatgcaggaacaagctctacatgggaatactttgttgtagttagggtctgtcttgagggaaaacaagacataaagggtatgtgaaatgttttctggtgatcatatcccaccgtgtcattagttcttttaaagtactttttctatattatcccaatttagctttttttgcaccctgcagcaattctatttctattttgtttcctgttatcattgttcccttttctgagtagaggatagataggtaagtggtgtaagtaatggcatggaaagatccaagaaccattaagtagattatatccctttttactatccttttcttaaagtgcttgacttaattctgaatagccacttacaaactttgatgagtatctttcatcttgggggttattttgaaaattgatggcatttggaataaaagttgctataaccttagtgtacgtttgggtttataaaatatactgaacataggaactcacatgactcccaatttttgaagtaaccataatttctaaaaaaaattcaaatgagctgagttacatttataccactcctgggaattattagaatagcatatgttctctgtttatgctctttgtaaaattggaaaagtaatgtgtagctctttttagtagtgccctgtgtgtagtttctgtaacagttctgtaactgtaacttaccattccagtctatttctgaatggttagtggagctgcccgtcaaagccagacctattacaagggatgatatttcccctgtcatgaatagaaactattgatgactcgattaacatacaaggatgatacagttcatggttaaagggagcatgcttccttttgctggtgaaggaacattaactgtagatttcatctagaagatcactagaaaaagcagcctcccatgtttgagcgtgtcctgcatgtcagtttccatgcagatgctttctgtacgtcttcacgtcctcctcatccatgaggttggaggtgaaagttacgtaactgacttgctcagggaacacatttcatgttgcaaccgggctccatagccacatttcagaccatttttcttttctttttttttttttttgggacagactctcgctctgttgcccaggctggagtgcagtggcgagatctcggctcgctgcaagctccgcctcctgggttcacaccattcttttgcctcagcctcagcctcccaagtagctgggactgcaggcacccgccaccacacccggctaattttttgtatttttagtagtgatggggtttcactgtgttagctaggatggtcttgatctcctgacctcatgatctgcctgccttggcctcccaaagtgctgggattacagcgcctggcctgaccatttttcatttaaccagcattcagattattaagtcaaacggaaaaaaaaaacagggatataaacctattagaaaccaatgtgactgtttcatgccttacatttatgtctggaaagttgaatataaggaaaaagttgttttttgaaatagtttttcattggttccaatgattattcgagagttttccgtgaaagaagtataggtaacataataaaagttaaagttaacagtcttaacacttcaattgtaagaatattttgtggtgtcagtgtattaatagctcctgaaagaaaattgtcaaatgtaatcagtctacatttttttcatgtgtatcaaagctacccatttattaaatcacagaagttaattgtgtttcattgggaattaatattgactttataggtcttgggtagattatttaaatagccctgctagctaatatgttaacccctgcccttattacaaatacatcctgacggataagggcaaaatattattgactagattatgcttgaatatctcaaaatgaaaacagaatgaagcagctaaccaaggaaacgattggacttaaagtgtacgtacttgatcacgttaaagaggcctcactgctgtgtaacaatagatgcttaaaataatccaccagccaacactcactacatgtgaaagtggtttactttcttgtgtctgtggggaagctctaattatatgattataattaagctacagtttattttctcattttctctgattaaattgtggtgggaaatatctggccaaatctagtcttttcttagtcatgttatttgttaattccattgacacatcttattaaaatttgcagcaaggtgttttcctgttaaagtaattgaagatttcagagtatcttatatctaaaaattgtgaatattctctgaaactagacctaaagttcttaaaatataaatgcgtcattcacgtagattatggagttacttttaaaatgtagctatccactgaagaaaattgtgaaaatgtcccattaacgatttgcaaatttatttatttagagatggggtcttgctttgttgcctggggtggagtgcaatggtgcgatcgtagctcgccatggcctccaactcctgtgctcaagcagtcttcctgctgcctcagcctcccatgttgcttgcaattacaggcctgagccactgggcctggctgccatttgtaaatttaaatcttaacacttatgtggtgtttccagttagatttcttctccgttctttgcatcaccttcttagatcttccccattcttctcaatcccctgttccctccatcttcacggtacctttcatggaggaaatagaagccatcactgggaataccctcagctttccaccgacaaatctattcctgcagacacccgtcattgcaatttatattttaacaaaggcttctgatcctaatttcaggaaatagcctctaaactcatctattagtcccaaattctttacccatttaatctgctattttatgcctcctatattcttaccttcagatgttgagaggttggggcataaaactttgcagcatgtctgcagtcttccctctagagtgaacttgatcctgctgtttgttctttttattctcttcaaagttaaatcatgttccagcattcatggtatttctccagcttgtcctccacgctcaccccattgtcatgaggactgcactgaacaaatagacaccttatagtgcttataggccatagttgctgacagataacacggtttaaaaaggaagtttcacagccttgtagcttatgaattcccatgtcagcctcattagcttttacaagctattttcttagcttgtaagaatgttgctagggattcacagttaatataaatatctgtagttttggaaaattgagacagtgcttgcccttctctagtcatcctgtaccttttagatttgacctcttttttggggggtgggggttggtggtgaaatataacaaagtgcataaagcagatgtacagttcaaccaactgtaaaataaacatctgggcagttgccgtgcacatcaagaagtaggacgctgccagctctcggaagccctcgtgtttgttaccgctctttaaagattgaggcaggtgttccatgaccttatccccaagtctctgtgttataattcatacgagttgggaggctgcagtatatttggatgatctaagacctcctcctttatttttgcttaccattggattttagttttctctttccaatgtttattttctgtgtgtattctgaagataattttatctgaccaagaaagtaggtatagaactaagtgtgttgtctgtaattgtttgttacaatataatataactaaggaaactttttcaatttttgcaaacccaattttattctgctattgtttcctgataggaattttgggaattttagagatccctgcgttcttttgtacaaaaaatacatctttctgaggccaggcacggtggctcatgcctgtaatcccagcactttgggaggccgaggccagtggatcacgaggtcaggagttcaagaccagcctgaccaacatggtgaaaccccatctctactaaaaatataaaattagctgggcatggtggtgcgtgcttctaatcccagctactcaggaggctgaggcagaagaaccgcttgaacctgggaggcagaggttgcagtgagccgagatagtgccactgcactccagcctgggtgacagagcgagactctctcgaaaaaaaaaaaaaaaaaaaaaagatacttctttctgttaaacatttcctttaaaaatctaaactcatcagaaaaatacctgcttgaccacattaatttcttgaagtatctctttcttttccttttggaatcatgtgtttgtaaagtcacatgatttaatcttctagagactctggatgcttctgttgttgatgtatatgtgcacactcacagtcttaaggaatttggcattttatgtttcactgtctttttactcttgctccccttcttttagtgtttttttttttttttttttttttttttttttttttttttgaggcagggtctcactctgttgcccaggctggagtgcaatggtgcgatcacggctcactgcagcctcagtctccctgggctcaggtgatcttcccacctcagtctccctggcatctgggtttcaggtgcatgccacgatacctggcttaatttttttttttgtagagatggggtcttgttgtgttgcccaggctagccttgaacacctgtgctcaagcaatcctcctcccttggcctcccgaagtgctgggatgacaggcatgagccgcacgcccagcccactccccttcctcaccagtcttgagcctcctgttctcctttttcccctgtctaggccctcacatccctccacttttctctttttccccatgacttggtcatgacacagaaacaaagtccccagtgacagtatcttctcaaaaaccaaacagtaaactctgaactttctttgctattggattcatgatttgtgattaagcgtattttcccctttgcaggctcttagttatgtgtggtagatgtacttctaaattacatttgctttaaaaatataaaaagtatagagtaacataaatgatgtagcataataaaactttaaatcattaatgatattcatagattgacatataagctattcccagtcattttctttttttctttttttttgggggatggacagagtcttactctgtgtcccaggctggagtgcagtgacaggatctcggctcactgcaacctctgcctcctggattccagcgattctcctgcgtcagcttcctgagtagctcagactacaggcccatgccaccacccccagctaatttttgtatttttagtagaggcagggtttcaccatgttggccaggttggttttgaactcccgacctcaagtgatctgcccgtctcagcctcccaaagtgctgggattagaagcatggaccaccatgcccagccctcattcatttcttgtactagaagtggtgatctttgacaatttgttttaatatgaagttgttttaatgaggggcaaatatttggagcaattagctaatcattacaacgttttttttttttttcttgttttgtttttctcttttctttttttcccccagctactgctcctcgcagagcagggctaacccataggtagtgtgcccagagtcagccatcattacattgttcacgcttacagcataagttaaggtaggactcaaaaaatttttctgtaaagacaatctcagaattaagtgctttcaggaattactatgcagctagaattttctgtaggattgaaggttctagcagctttgagcattgatactgatcttgagaatgaatccaattggcagtcatcccctggaagacttaatttgaggtctttatacgtacttgcgctacagtaaataagaatgtgtcctagatggaggcaaaatggggtgggtttcaagcatttaataaatgtgttaaacattttaactattatttcctcttttcaatttcaaatagtgttaaatgattgttatgggtaggaatagggtaaacccatttctagggcatggtttagaacattggtgcagtttttttcccaagaatatcttaatcacagccctggtttttagtctgtttttctaagaactccgggagttatgctggtttcctcagggattgtttttggcattttcctcatcatagaaccttatggcatcaccttggagacacagcgttagtttaaggaatggacatgtgatcacgcaggtcaattggagtcccatttggtgcttttctgtaggagtagcagggagagactgcctcttctggttggattgctagtggtgtgtgggctgccaagtggcccccttcctggcaccaagcagaatgcagcacacacagggagcagagcccggaggcttgagcctgatggcacttgaggaatctgggtcctggaatggtagatgtcctccatgctacccacttgcatagtgaatacattgcctttttgtctaaggttaagttttcgttgttgttgttacatgcagaattgagaaatatggccaatatcttagggaaggtggcaagttaggaactgtactagcaggctattaaaagaatcacagaggctagtagcctttagtttttaattttttgattgtctatttttgcttgtttgtgatgagtatttctacacctggccagggatgcattcagataaacattttggatacctcctctaaagtgtctgtccacaccacaggatcaccgcctggtcccttagtgctgacattccactccaggagatgctgggctcccgggtggcgcgctgtgaggatgctcgagctgtatcaattgtgaacctcactttcaggagttcagtaattgtgagacggtatcttcaggcattgtggaactctttgggggatgtgacattccagggcattctggagaaaggaataatgttcagtaataaaaccctggagacaggaattcttactgtacctgtgacccatgaagtcttagggcaaatgtagaaggctctgtttggctgaatgaatcttgaggcatccaccttgccttggagttactttatttacagcaacagacacactcacaaagaaagtttgtaagcaaaatattacaacactttgttttgcttctggttctgccattctgctgtcatctttgcaagctgcaaaatgtgagggacaggagaagagaagtttttttcctcttatgtcatggccttcagcattcttagaccagagcctgctttctttaacactctaaccacttttattagtttgcttattcagtggtagaatgtaaactccaagaggtcaggagtcacactagtcactatattcctggatagccccagccaaatacctgacacagcaggtgcttgatagacaatctgttgaattatatgcaatctgttgaatgaagctcttaagttatctagattttaggaactactggggcagattctcatcagacaggtgcaaagaatgggtattttaaagcaattagatttaacagaacatcattatgcaaatgtagctctgggatgtcccactcagatgccaggcttataatgttattgaagtgttacatgaatttgtgtgtgtttgtgggcggagtggattctcttgttaatattgggcctcaggtttattgatattttcgatagaaataacttgaaaattgctgatgaaagatacaaatgtttctttcccaggtgttttaaattttcttaggaatatatgacaagctggcgttggattgcgtgtcctaggttttgttaccttggcccagtgctgctgtcactatcccaaccacctggtctgtctgatcctggagcactgggtgagaagctgtttattctgtcagtctgactgtattagcagtcccccctccccacagaggcagagaagactccactctgttatgtaattgtgagtgctgggagatagtggggggagttataatttagggaatttccatattggagatagtactgcctatgtgtcatgatgcatttgacatcatatgggttattcatcgatgggttattcaacacgtttgaatagtaaggcctccaattgccatttatagcatatgtgctaaagaaacaaaatggtgtgttgggagttacatccatcatctttcccctttggttgaaatttaaagtgacagactgttgtactttaaaaaccgtattgatcaaatcatcttaaacacatactaaattcctagaaaaaaatctgcaattgatactgtagttttttctatattacaattatttatggccaggtgtggtggctcatgcctgtaaactcttcgggagattgaaacgggaggattgcactcgcatctggataacagagtgagaccgtgtcccttaaaaaattcattttaaaacccgaattgaaattagtcgtaaatttttaaacacttatggtgagaacatttgcatttctatcataggacctctgtgttccttgttcttctattccactttcttgtcccaccttctggtaactgtggttcttgctttttctgtttcaagttcttgcccttggcttctcttcccttcccagcatctctgcctgccttgggtttctttctactctctcaccttcgtttcccacatcttctctatttgttctccgccctgtgattcactctatatttaaatctacaattttaccctccctcgttggtttattttttaattgtttctaaatctcagtaagcaatttgaaataagagcaaggtgtggtgcctgatcaattaccctatggctgccacctctttagaactattggcttagaaatcacctttggtcacacgaaatagggcatttattgcaggtttattagtggggagaaataacaattgttccatgcacagtattggtgcgtttctattctcaatcaatcaagaataaccggtgaattttccaagatggttatttaaagtgctatactaataatactgaaagtaagccatatgcacaacctggcaattttttaaaatatcttttaagtactatatatctaagagcagattacattttcagtggcagtcctcattttctccacattgagttatgtcttggtaccacgctttattgcaaaactctcacaactaaaggatttaaagtttattattgcgattttaaagcaggatagaaaggaaaggagagaaaaataatttttctgagtgaagggacctagttcttataatagcattttgatctgaggactgtgctgtgataaataactcttactgtagaatctagatgaaattaaccctgggagaaccctatatatccctgaggcatttggtggccgactacgacagtgtgtaatctgttttcacatagtatagtacacagatgtatatgtgagctgagtgtaaatgcagacttctttcacctttttgaagactatctttttgaagacttttcttggagaggatttatctaacacctgtttgaatcttctctttttgttatcgtggtgatcttatttgagtagtattttggtgattgtgtttgatcataaatatatagcagcagaaaatttttgcagcaccaaactcataattcttggatttaccatatctaaaggaatgccaattttgcatattttttcctatatctttacaagcctcattaaaatattaaacttaaaaattttttaaagcataattgcgtttttcttttcaaacttctgaagaaatgtacaagatttaaaattaattttgataaattaatttgcatttactttgtaagccagcactttgtagtgtgaaataatattgaaaatgggaaacaatatgtattgataattaaatgaatatacaaccagttttcttcccggaagacattttcatgtaccatgtaaaaggtactttttggaattatttatacttttatagttttccatgcgtgtgtgattagacttctgagaaaaccttggataattttacgatgataaacatttatatttcatttcagtgtagttcagtcacttaaaaatatccacttaattttattttggggacaactgtagattcacaagcggttataagaaataatacagagaaatcctctgcccccttcatcagtttccccttatggtggcatcttgttaaatgtggagcaatgccacatctaggatattgactttagtacagtcaagaaacagaacgtttccatcaccacaaggatctctcatgttgcccttctgcagccacactgacctctcctatctccttccacactgctcggcaaccatgaatctgttctccatttctataaatttatcatttcaaaaatgttatataaatagaattatactttggatattgctcttttttcattcagcatagttccctgacgattcatctagattgttttctatttcagtaattcatttcttttttattaagtagtgttccatggaaactgtgtaccacagattgtttaaccattcacctattaaagacatctgggttgtttccatgtttcggtggttacaaataaagtcgctataaacatttgtctatagattttattgtgtatccatttttttctgtgataagtgcctaggaattcagttgttggcttgtatgttaattgtatgtttgttgtttaagacagcggcccccaacctttttggcaccagggaccggtttcttcaaagacagtttttccatggaccaagggtgggaggtggtgtggatggttttgggatgaaactgttccacctcacgtcatcaggcattaggttttcacaagaagcacgcagtctagatccctcacctgtgcagttcacagtagggtttgtgctcctatgagaatctaatgctgctgctgatttgcccggaggagctcaggcgggaatgctccttcgtccactgctcccctcctgctgtgcagcctggttcctaacaggtcatggactggtaacagttgttggcctgggggttggggacccctggtttaagaaaccttttttgaagtgttatactattttacgttgtcaccagaaatgtgtgaatgtgatccagtttcacatcctcatcattatttggtgttaccattatctttcattttggccattctgagatgtatgtggtgataccttattttggttttaatttgcattcccctaatgttgaacattgttttttcatgtgcttgtttgtcatctctatatcctcttcagtgaaacgtttatgtcttttatccattttctaactggatcgtttttcactgttgaattttaagagttctttatatattttagatactaggcatttgttgaacatttggcgtacaaatatattctcactctgtagactctatttccattcttttaacagggtcttttgcgtagaaaatgtttttaattttgatgaagtcagattgataagttttttcttttatgggtcatgcttttgctgtcgagactaagaattctgcctagacttggatcctgaaaattttctcgtgtgttggtttcttttaaaagttctgtagttttatgtttcacattaaagtccatggcacattttgagttaacttttgtatatggttgaggttctttttttgcttttaaacccatggatatgcaattgctcctgcaccatttgttgaaaagcctattttttctccattgaattttttttgcacctctctcaaaaatcacttggacatatctgttcatctgtttttgcattttctactctatttcattgatctgtgtatgtcccccagctgataatatattgtcttgattactatagctatataataagctttgaaatcaggtacactgatgattgcccctttattttctttttcaaaattgtttctggttattctagttcctttgtcttttcagataaattttagcatacacttttctgtatctagaaaaaaatcttgctgtgattttgataggaattgcatcaaatctttggaagaattgacatctttactgtgttgagtcttccaatctatgaacatggtatgtctcaccatttgtttacatcattgatttctttcatcagcatttttagttttcagtatatgagtcctgtacatgtttcggtagctttacacttaagaacttaattttctttggagcgattgtaagtagtattgtattttaaattttggtgtcagtgtgttcactgctagcatataggagtttttatcttatatcctgtgaccttgctgatttgaggccgcaacttctgcagtgtaatgtaaagccattgaacatggagagggcaaaacaaaaaagtaaattggagtgcctcatacaggagtagattgtttgctagagaatggtggtagtggacatgtgtctcaattgtattcattttcagtttgagtgagtcacttttcatcttgtgcttttctaacacctggaacctcttttccaagaaactctggttccttttaggggagaataatttgaaaaccaagattctgggtaccattgcaataggaggccattacttcagaactctttcagtggtcggaactaagaaataaaaataattgagtttgtatcaatgttttcaattcaaatttagcagaaaaattcttccccttaacttatttcattatatatttctattcattttctcttacactgaaaatagtgatttcttaatgatatcaacttatttgctttatcttactatacacataaatgttttaaaattgctgtattaaaattaaaactattgaataaaatttaagatttccttgcaggtttttttgaagggcatagtcctttcaatatatactgctgaggatgtagagacagaacactgactttagaagtctcttcaagtcttttttccaggctgggcgtggtggctcatgcctgtagtcccagcactttgggaggccgaggtgggtgtatcacctgaggtcagtcaggagtttgagaccagcctggccaacatggtgaaactctgtctctactaaaaatacaaaaaaattagctaggcgtggtggcgggcaccggtaatcccagccacttgggaggctgaggcaggagaattgcttgaacctgcgaggcagaggttgcaatgagccgagattgtgccattgcactccagcttgggcgacaagaatgaaattctgtctcaaaaaaaaaaaaaagtctcttcatatattttttctgtgtagatattttaccgattcgatgttaatagtggtttatttctgtttctctaattctgagttttcaatttctggattaattctttccatataaataggtttgaagtcaaaattaaataaaaagttctacatagagaagcattctctgttttcattcttcccagtatcaccctataggtaaccatttttattacttttttgttgtaaaagaaagtacttgctttttcttccttctcatacacaatgtagtagtctatggtctctggtctcctcctttctttttttttttatttcacaatatattttggagattactccattatagcacatagagatcttcctcactcctttttacagttacattaagtactgggtaattttgccatgtgtacttttattagatcctgcagaattcccctttatggggattttattttgtactttcatcaacagtgtttgtgacgttcagtttcttctgaggcttgtcacaagagcagatttttgccagataggtgagaagtgctatttcagtgtagtttttatttacatttatggggatagttgaacatctttaaaaacatttaaagacttttgtctttttgtcaactgttggttcatgtcttttgcctatttgtatattggatttttgataattattgtttttattttatttatttatttattttgagacagagtcttgctctgtcaccaggttggagtgcagtggcgtgatctcagctcactgcaacctctgcctcctgggttcaagcaattctcctgcctcagcctcccaagtaactgggattacaggcatgcaccaccatgcccagctaatttttgtatttttagtagagacagggttttaccatgttggccaggatggtctcgatctcctgacctcgtgatccacctgcctcagcctcccaaagtgctgggattacaggcgtgagctaccgcgcccggcctattgtttttatttctaaagaggaaggaagattatttatttggaagataagttgtgaaagttacttcccagtttgccattggtcttttgactttgcctacaattttattttatttatttatttatttatttttatttttattttttgccaggaatgagttttaaagaatgtatcttttttatatttgtaatttgtcatcgttgtaatttcatgtgatctggatctttaggtacatgtttcacaatggatggaatagaaaagttaggaattttgtgtaggaaagcaaggaatagaatagaaaataaaatagaaaagttaggaattactttttatgtttgcattctctagctgctcactttttttgactatatttcaagccaactgtcacagggcatcattccaggtcctattttggtttctttcctcagtcaatactagaaaaccacagagtgccattcccggcatttcatctatcccatacttgtcatttgtaaaacaagtgcctagtgatgttaattatttctgtagagttgcatttatgctcttttaatttttctgtatttgtgctgaatttccatagtctgtggacagatttgctctgggtgctatagtcagctgagttggagtctagaccatttataacttaactcttcgacctatttaactgtctgcttccttgctcttagtttgagttactcaaattccagttgccttaactgtaaaattggctagtagagccatgtacctccagggaattcagtgtattgtttagatgatgattaggtcttatttatgttttcatataagctattataacaaaattgcagtttaaaatgaatatataggaaaatgttttctttagaaacttagaataaaccagaacattcttaaatttccacttattgcatgttgatggagcttgactctcttccctgtaaggatgaacattgcagaaagactgtgaaaaagtggtgccatcacatcatcagatctcttattgcagaagttataattctaagagaaaacaatctgcaataaggagttctatcatatttttgtaagtatattattgacttccaattaaaattagtcctagtaataatggcatctgtgaataaggaaatctgaaaccaataacgtgtaaaattgagttaaatattgttgagccagttatataagtcatgttaatttctaggtgttacaaacagaagaaagtgttctcaagcttctccgttccccagacagaatctgctgggttcctgctattgacatcaaagttacttgttctcccattaggctgctgttaaaacgaacacttaaaaattatcttttgtccatcatacttttgtgggaaacatttttctccaatggatttcaaatcccatatctcttactatggtatttccatccaattttcatggttttgaagcagagcaatcagtatggagtagggggatggagtgaaaatgataactttataattaaaatcggcacggaagggtttggatcacgggatggtgggattaaaggtgtaacctgtgaggacagtaacagaggagacccactggaaacattgtaggacttggagagcctgtcgggtgagtgccctggggatctttatgtgcccatttgtcattttcacttctagaagtgagaagcatcaggacactgtctgtgccacctctgtcttcccactctattccaaacctcctgggctggtaggagggctgaatgagataacacaaagcacttagaaccgtgtgtgacatgtattaggaactgaagaagagttagctattacacataacatttgattggtattaaataatataaacattgcttcctgtactctctattatataaataaagagcaaggaatggtgtgtaattctgtgaaactgtgtagtctcagatttggatctgtctttgcatgtgctgcttcctcctgccccagttagtaagtgtcaataatcatgtaaattcttttttttctttccttttcttttttcttttttttctttttgagacagagtcttgctctgttggccaggctggtgtgcaatggtgtgatattggctcactgcaacctctgcctcccaggctcaagcaattgtcatgcctcagtttccttagtagctgggattacaggtgtgtgctaccatgcttggctgattttttgtatttttagtagagacggggtttcaccatgttggcgaggctggtctcaaactccttaagcagtccacctgcctcggcctcccaaagtgctgggattacagacgtgacccagtgcacccaccaataatgtaaattcttactgaaacagtcatgcttgtgtaggtactgtctgtggtcacttttgttctacaatgacagagctgtgtagatgtgacagagattatacagcctgcaaaacaaaatacttagtatctggcctgttatagggcaagcttgccaactcttacatacagagtgttctgatccaaggaaaaagtaataaaaagtacccaattatagagcagcttcctgaaatcaacatttgttctttcttttacatctcctattgaagaataggatgttgtatataagaggatagcacaaaatgtttcctcaagttttcatttatgtcactgaagagttgactttaaagaattattataaattaataaaatgtaaccatttggaataagctatgtaaatgaatttgaaagtttgaagttgttgcttttctttagtaatgaaaaactaacccatgaaatgtgtggtagatttttcacttattaagagtaaatatgcgcatttatggcgtgcagtgtttcacttaagaaagtgggtatttcagggcagcacctagccactgctggtgtacagtgcggactgggagcacagtgccctaggcacaggcagcctgtgagtatccgtggcagttcgtttctaactagcaaaggaaaaggacttctaaaatcaatactggttttaaaatgtatcattactgttatttggctcagttggattcagagccataataaatagtatgaacatcggcctaagttaaagtttgcatttagacctgattgtgaatggaaagatgtacatatgacttgagagagtatggttttgacagagtggttgttaatgcctcagaactaaagaggtttcatgaatacataggttttcagtacagtctccttaccggcaggggaatatcagacaagtggtgtttttcagacagtgaagcagatggctctttctcttcagtacagggtgtaccaacaaagagagacagttacacaaatgttaacccctgagggagagagaaaacaattgcagtcagttgttctttataagtctgtatcttgacttcacagtggtgtgaaaaagtaatttcttcttttataaaaagcattaaatgcacaggagcagcctgtaatctgagtccaactaaaatggtggaagatgatgtaatcacttaaaaaggaaacagactgttatgtttgacatttctggagtaacgtggtggtggactacttgggcccgatataccgcttccaaattctcgttaaaacgtccagcagttgtgctataaagcaaattgccatatgccaagatctgggcagaatgttcttcaatatggctggtgaaacagattgcgaatggtcttggactatatagcacatgttctattctctgaactagaacaagacaaatgccccacgctgggtaggacatgttttaaaattcatgtacacagtgtgcatagctttgggaggccttgggtcatgctgagtggtccaagtttgtcattcccagtctgtggagccagtcatacctgggtccctcacctgctcctcctctgtctccactagctcctttctctccactttgacttaaaaacccaaactcccaacatgcagccccgcagcaggaggcagagggaggtgctaagggtgccgtccaaccctgactgcaaatcacttaaaagctttttgaaacggaggaagagccgtgcatccccgtgtttcgtgtacaacatatgatacatgtgacagttgacaagagtgcctgagtctcagagcaggaagagttatcctgcctccacatgcattgaagggaatatatgtcacacgttactagccaggctcagaggagaacacatctcatttacaagttcaaatctgaaagggagaaatgtgctagtatttagtggatcttgaggaaactagggatgtgttacccatctgtgcaggaacattagatctagatggggctctcctagtcaaaacgctgagcatgtggcgtaggaaaaaatttccaggatgcaggggaaggacagaatgacttggaggacagtgtctctctctgaaaatggttacatgtgaaacacaggtaacaaatttaggataaatctggtatcttaaaaaaagaaacatgactttgggaaaagaagaaaccagggggccctaagggggaaaagactgagatgaaaacagaaacatacaaacaaaaaagctgatcgaaataaaagaatgcgaggaaaccaaaactgcaatgagacttaaaatccctactaagataatcagaagacttgatctccaaaaatagaagaggagtatggatggcaaacttggacactctcaggatgcagaggagaaaaagataaaagtgggtaaatacgaaaggtagacgtggaggacagataatggatccttcacccaagaggagttcctgaacaggaaactgaagtcatctggaaaaccacaattaaattgactgcactgcagaagagtgtgagtaaatagcataagaaaccctgacagtcggccaaaattaacgaacagaggtttctacttagatctatcctcacaatttgaatttttaggataaaacaatcccaggagatagagcaggttgtgaagaaacacaggttaggtttgtctcaggtatcttgtctattaaatgctaggaatctgtaaggctgtggttcagtaactgtcatcagctacgttgttaacatacagtttacaggctattcagatgtaaaacaacagcatttatgttccattcaccccttaaaaagctacataaatatgagtttcatccacggaggagaccacccttagattttaggttatgtctctgactttgaagggagagagtctggagcagtgcgaagtcttacagcttcctgaccttttgggaggttgggaaatatttatgtgtgtcctgtgactggtagttagcagaaaaggctcccaagctagtccaacacaactgatcaggaagttgggtcatccaacagaaaatgtagcccacgttacagttagaaaattaaaaatccagggctaggcaaatgctttcttaaatatgatatgaaaagcacaagcaataaaaggaaaatgataaattgaacttaatcaaaatggaaaacctctgtgcttcagaacacgccctattgcctcttaccctgtgtaactaggagggagcccatctgaggacaattcaatacctcaggagggcagagcggaagagggcaagaccctgagctttgagaacgtcactgggcccccaaaatgaaccctgtaacttgctgtacctctgggttgattgttgtgtgagatggtcagtttctctgttgtgagagttggagtttgttacttgcagctgactacatccttagtgatccatgctgaaagaaaaagttaatgccagcccaggaagagagcacacagtgtaggagagcgtgcattgcaggctttactggcagaattgcaaatgtgtaaaggtgatggattttatttcaaaagccagagttacctaaattctcacattgtagaaacttgcttcagtctgtttcttatattcccaattttaaaatactttatacaagacataggaaaagaaaaatgcaggcttttgatgctgaaacttaaattttgtaaactaaaatccagtggttaatttgaaaagtaacatcaagtagagtttattctatgctcaatattaagaattattgcttagtattaagaaatttcctatacggatgtagtgtgttttacagtggcgctatgtccttataaactgataagctgaaaatattgtaagttgaaaatgcatacacctaacctactgaacatcatagcctagcctaccctaccttaaacgtgctcagagcacttacattagcctagaagggcagaatcacctaacacgaatcctgtcttataatcaagtgttgaaagtctcatataatttattgaacactaagcgaaagtgaagaacagaatggttgtatgggtcccattgcaaagttgaaaaattgcaagtcaggttctctctgtaattcaaattatgaacaagtcaatgacagaaaaccatatggtctcaatagatgttagggaggtacttgacaaaacttaacatctatcccttctaaaaagaaaatcccttagtaaaaggattgaaaggtgttttccatcttaacatagtcaaaggtgtgttgcaaattaatagtcaacatcatttatgacagtgaaaccctagaaacatttaagcttcccaaataaggttgttggcaacaccattaaaaatgttctgttctttttttttttggatgtgcgatactttacttggcactaaaaagtaaatactaaatgacaagagaaagcaaaattgttatttgaagatattatatgattagaaaaacaaaggtcaacagacaaatggttagaagcaatttaataaaagtgcttgttcacaaattcagtgtacaaacttcagtagcttttgtatatattaaccatttataatcaacaacaaagaagacctcattcacaatcacaagcccaaaaacttgaaataaacttgataagtacatgatttatatgaagaaaaccataaaactttaaagaggatctttaaaaagtttgaaaacatgaagtcatactttgttttaacataagaatagctaactttgtaaaatgccatgtttctttgctctgtaaattaaatgtcatctcagtccaaattgtggatttttcttttttttaacttgacactctgatatccacggtaattggagcaatggaagtcttggatttgctgcagtgtgttttgcatagttgaaggactggggaattgggggagagctgagtctggaatcaggaacccactgttgcctaaagtggctcactccttatgagcaataccaccccacttaactgatctgaagttttccacttgggatatgttccttttctggaagacttgtgacttctgcccccaagctgtgcacaggaggactcactgtcatcagatgctgtggttacacaaaatatttttttctacaattgattttcttcacataaatcgtgtacttgtcaagtctttggaggttgggttgccttactgtagtgtcatagccagtcacagacctggcagcagtgcattgtaactctgaaagcccttcagtggctgccaccagaaggtctctctcctgcatactcctttggccactatacaggtcttccaatttaacctacactatatttttactggccttttttccagtgctttgaataaggtacgtttttccccaccccagaacctttacatattctgttccctctgcctagaccaatttctaaccatgctctgctcctccagtccccactacacacacccacacccccacacccccggtcaactctaattcacctttcaggtctcagattcagtaatatttcttcaaagagactttttaaaatttttcagaattgattaggtccccttgttatgcccattatttcagattgtatgctttttttcccacagcacttaggtgtaatcatgtattttatgcagtttctttatagtctgtcactcccattgaaggacacagactgtgtctctttagttcactatcgtatatctaacacctgtaattgtatgtgccacatagtagacattcgttaaatattttttagtgaattaatgtgcagtgattttaagcaagtattagttgaataacgttttacatgtttaatgatgctgcatacgcattttccgatagtgtctaccacggtttatcacagaggccagtgtgggctctcacatgtaataaagctaatctgaagttaatttgcaaaaaaaaaaaaaaattgtgcattgtgagaaaattttagaaaacaaacactagtggagacttgcctttacatgtcacaaacttatgctaaagctgtaattgttaaatcagtataatactgacccaggactagacagaaaatgaaataaagtctagaagtaagcccaagtacatatgggggtttagtgtgtgttcaatgtatttcattttaaagtagtgtaaaatagatggttggttatcagcctgcaagttggctcccagtgatcattgccttgtagtattcttatccgtgtatagactctccttacatgtgtagggctgacctgtgtaaccagtaggatagaatgaagaggatagtgtgtgacttccaagggtaaatcatacaagacattgtaacctctgtcttgtgctcccttgcatcatttgctcttgggggagctggctacctttcgtgaggacactcaagcaactctgtggagaagtccttgtggagaggaactgaggccttggtcaaccgccaccatcaacttgcctgccatgtgggtgagccatctgggaagtggatcctccagccccagggaagccttcagatgacggcagctctgggaggcatcttgcctgcaacctcatgtggatacagctaaaccagagccacagaactaagctgctcctgaatttctgactcacagaaatggtgtgagaaaatgctgattgctgttttaagccatgaagttttggggtaattcatatacagcaataagtaactgatcagatggattattcagtcagtggtgtggggatagccagctagaattggggaaaaaataagttggattcttactgaattctgcatcaagaaaattccagatgtgctgggcatggtagcttatgcctgcaatcctagtgctttgggaggctgaggtaggaggattgcttgggcccaggagtttgaggctgcagtgagccatgatcatgcctctgcactccagcccgggtgacagagtgagaccctgccttgggggaaaaaaagaaaatctcagatggatcaaatatttaaatgtaaaaatggaaccgttaatttattataagcctgaaaaattttaaacttttggggtggagaaggatttcctaactatgaatatgcaatccccaagccataaattaaaataacaaaccttataaacagggtgaaagataaaccaccaattaggaagatttgagcaacctgtattacaaaaggcagtgtctcggagaactcttaaaaatcagtaagaagactctataaatgggatggctgaggacacgaacaggcaattcacaaagtagaaataaatgtatgaacagatattagccaagaaatataatttagaacaatgagaggtcacattgtatttaccagattcacagaggtgaaaaagaccgacaaggttaaagagattccttgattggcaggaagattatacggtgtgggtggggacacagatttgtctgacttttctggagggcagtctagtaacatgtctcaaaatgcaaataccaaatgagtgcacattgattcagctattgtgtaaatttatgctaaggtaatcggacacacacagaaagatgtgtatactgttaaaaaaaaatcccgaatttcaaaaatgtcaaattttcttcctttttcttttctttctttttttcctctatttccccttctattgtctctctttccagttcctcttggactttcctggatctgtctccacttctcaacattgtactcataccttttaaatcttggtttcttctcaatattagtaatttctttaattttaacttccttgttgccaactctctattctgaaatcgattctaacattcagccctgcttcgaaaagtttattttggcaattacttttgcaaaactaatttctgataaattttttcttttaggattctgttctgtagtgggtgtatagctgttcaatctctctgaggatatgaattagagttttaaaaacttgccttagacacgttgattgtggctgtttctcccagggtttgtggctgtgtgtcttcatcttgctccttccctcccatgctttaagatcttcaagtcctgatggtcctcagctaaatatccatgtttaacgataaaggactaggttaattaatactgcagctgccgcaggttttctctgtagttgtgtggacattccagctgccccctgcgctaaatggaggatggactgcaggctctggaatgtggtcaggttgcttggcaagcttccccgtggggtgctgtttgggtggggaaagctgggttccccccacactgctatcataagcagtacttggtcaggaggtgcagcagtgtaccctgtcaggcagagctgctgcttttcatcccacgactccccgtctctgtgtctgttgtaacagttctgagttccctttgttctctctcaagccctaatgtccacacctgaagctctccacagagaactcatccatgttgggttcctttttcactgccacacacagggcagggggctgtgtgtgggggtgcttcctagccacgctgttccaaactatatttttattttatcatttatttattatatatttatttttggagacagagtctcactctgttgcccaggctggagtgcagtggcacgatctcggctcactgcaacctccgcctcctgggctcaagcaattctcctgcgtcagcctcccgagtagctgggattacaggtgcacgccaccatgcccagctaatttttgtattttagtaaagatgggggtttcaccatgttggccaggctggtcttgaactcctgggctcaagtgatccgcctgcctcggcttcccaaagtgctgggattacaggcatgaaccactgcgccggcccccaaactctatttttaaatcaacttcttgttgagccactcttgcctgtatttgttggctctgagcttctcttggatcccttgagaactgctctcagtcatctttcgggggctacaattaacattgttctgtcttccaagagtccctcatagttttggtctcacatattttgtgttttctaggcattccataaaatatatggtctgctgatggcactggttttttgtcttgcaggattctttaattctacttaaaaacaaaagtccttgttagttcataagaccttgggtgggacgggaggtagacatttgtgctcagatgacctgttcttttttctgtgggtgttatcacttgcgtttcttcgagcatattcactttgacattttcttctgcttactgtatcagccatgtacccaggggtcaggagtgtacacatacacatgaggaaaccttgaggtcgggcagggatttggatccaggctgtgactccaaagcctgccctcttaacctctctgctgtctcttctgtttgtgcagtggggggccctctttcatgctgtttgtttacttcaaaggcttggtgtttcttgtatttctgttcacatttgtaggtaaggatctgcaactcagcgttgcgtgaaggttctcacgcaggagctcagcttcaggtgactttgcaggggaagggcagggagcatatagcggggcagggtattcactctgctgccctgctcgctggggggccggcggggtgggcttctgctccacggagttggtcactttgtcggctctgctgtcttccttgttaggacctctcatcggagagttgcatgcatgctcaccgacctcccaccccttccccggagcagacccctgagtcagacagttcaaacgaggacttgctcagctcttccagcttctcgttaattacttggccaattatctatggcctgcttctcctggcctgtgctgcactgataatgggattatgctgagcttctgctgaggaaacttttcaactgacatgggttccttctatttctttagatttgccatcattggtcccgtcacttttctagaaatttaatctgttccacaactctttattgtgcggggcaatgtgctgggcattagaaaataatggtgaagagaagacctgtcacgatggagcttatgtatggtcttgttggggagacaggcattaaacaattaatttgcacacacgtagttcttgttctgtgaggagaagttgccctgcgctgagggggcatatgaaaaggctaacttactgggagaggggttgccatggaagtccacctggagcacgtgtgacaattgacctgagattccaaggaagaaaaggagtgactcagtgaccgggaatggggataagagtgttccaagctttggaaacaggatggggaaagacctttattcgtagatggaggggaacggggtctgccagcatcactcctcaaggacatttactattgctgtggttcattttcattctgtatttttcttctgtttaatgggatttgggaggaagaaaaagatgaacttggttttgatccaagtaacctcagagaataatgacgtgggagcattttacaatgcaaacaataaatggaaaagcatgaatttatgtactgtatgtgaaatatatagacacatacatacatataggctgaacatcccaaatccgaaatttgcaatgttccaaaatccaaaacttcttgagccacctacatgatgctcaaactgagtgctcattggagcatttcagatttcgtatttttctatttgggatgctcagctagttgatatgaggcagatattcccaaatctgaaaaagattcaaaacctaatccaaaaatccaaaggctctctggtcctgaacctttcagataagggattttcaacctgtatttaatattgggaagcaatataccaataccaaaaacgttgtctgtgagaggtgagatgacaaatgatttttattacctttttaaaactcctaatttgaatttcaacttttctatgactgtggattgtttttataatcagaaaaaaagttcctaaaatgatgtttatcttatggtttggcttatgtaaatgcagagtttgtcactaggtcaatatccgcaacattataaagatgttactgtgtacttactggaaatggcctgtgattggtgacaaagctgacttacacaaaggagaacattatccttaggaattcttgctagtatctcataatgtaattgttttaacgttgttaaatggttcacagtgatcagagacttaaaatctttgtctcctacacagcgttttaagagttacagaaaagctatcattttgagctaccttgagactgaagtgtctgcagaatagcacttacatattcaggctgacaatatgtgtttgaggaattggcggttcagtttggccaactttggtgttgtaacacttgagattgtattaagctgcaagtaacaaattcagatgaacagttgcttaaccaagtaacttaaaggcacaagctttaagcttttaacgttttcaagttcaggtcatgtaggggagctatgtcattaaggagactgactctttctgtcttcttgatttactgtagagtacggcttttgacctcatcataacagagtggctgctgcccctctagaaactccatctgtgattcaggcgaaagggaagggcctgctagttggcttgtcctttttattttttatcagaaaaatagtagctttcaaagaaaccacccccattagacttccgtttatatttcagtgaccagaactgtgagaaagccgtctttagctgcaaggaaacctgagaaatcaagcttttgtggttatgtttttcaaactggagcacattgctgttcaaaacaaaatcagagttctgttaataaataaggagagaatggatattggtaggcaacttgctgtgtcagctgcaggagttatgtgcttagaggtggtaattgaagtcaagagtgtgattaacattactcagggggagtatacagagtaagaagagaatccatgaagggactgaaaggaagtttagtgttgaagagactggcagaagaataggtattctcaaagggaaccaagaacgaggggcaagtgggaggaggtggtcacctggagggtgtggaccagtggtacacaggttaggagagggggaagggcagagtttacattgcccgtatgctggcgagtgaagtccactaggaactgagacatgaacttgaggcttagcaaaagagagcgacttagagaaagagcacccgcactggtgactgtgggctgcatggtgaaggggggcaaagcagtgacagcgggagtgagcccctctcaaaaactgatgccaactacgcaggacagagagggggcggggaagggggagtgacctgagggagactggggctcaagaaaagcctttttgtgttggttgttttaaaggctggcgatactgtagcatgcttagttctaaggagaggaagggccattaaagacgtttgagaaggatcctagaaggattgtattttccaacggaggtggaaggggttgagatccacagcccaggggatatgctttgaaggaaggagaaaagcacctctccttccctaaaagaaggcaggaaaggtgtgtggacagaaattctagagagcatgaaatgcgggtaattgggctgcaataagaatccagtcatggttagagaacctgaatttaattaaggtcagtgtatgtctgtagagtgccattatcttacatagaaattatttttgaaaattttagttgacatttttgaatgatacctactagtactacagataatagaagcataaatatgcacaaaagcagttaaaacttaaccgttcgtcttaaagtaatttataactaatacttattgatgccctactctgtctcagtcaaaaagctaaacaccttccctatgcacaagaaaaacctatgcagtaggcgttactagttgtcctcattttatttttattttttattttttttcaaacttaaacatttttttttgtgtagagacagggtctacctttgtttcccaggctggtctccaactcctgggctcaagtgatcctcccgcctctgcctcccaaagtgctgggattacaggcatgaaccatagcacccaccctttatccccattttaaagatgacaaaacctaggctcaaagaacttaacatgttctagatcacgtggctagtaagtggtgacaccagaatttgaaccacgtatctgactccagagtggtggtgccagctgctgttctgtggattgagccatatgaaattgactatttagcaagagaaatataaaacatcggcatttttatatgtctctacctaatacacttcctcacctcaatcattgccaaggtcagtggactgcttacttggtgccaggcattgccctaagtgttttgattgccataatctgttgtaatattttgaaatatttgcagtcttaattgtcctgatttaaaaaatcatgtttttgaatatgataatatactttaaatgagtatgtttgattagcgatgttgctttttcctatgttggcaaaattatattttgaggaaacgattagaaatattggcaaaacatagagaaaaatcattacacatctagtgtctcacaacatgaatagttttttggggcatttttcacaacatctgattcattgagtggtagtcccccaagagatacctgtgaattggtttttaattcagtagatttctgttttattgtatatttgttgacttgtgatcaacatatattctcttctatttttgaagcttattttgggtaaaaagaaagattacctttctatcttctcactttatccccaacttatgaataccataggtatcaaccagtgatattactagcaaatcacccactctcccactttactaataaaatgttgtcttgaattcttgcatttccgctaaaaaaaatcccattcaaaattatgaatttagaaatgggatgaaagctgagtgcagtggctcaggcctataatcctggcaatttgaaaggctgaggtggggggatcaattgagccaagaatgtgagaccagcctgggcaatagtgagaccctgtcactaccaaaacataacaaaaattagcctggtgtggtggcatgtgcctgtggttccagctactagggagactgagatggaaggatcacttgagccccagaggttaagattgcagtgaattatgattgtgccactgcactccagcctgggtgacagcgagaccctgtttctattaaaaaaacacatggggtgatttccctctccccagtttggaagtcttcaataaaaggataaaaagatgtgaagcggttttagccatctctttttggcctccatgtaatcagattttgtgcttatttgagacacttaaaaagtatctggctaattgtgctctctgttttgaggacctgatcttaaactggatggtcttgatattttcgtgtaacttttagttcaggtacaagaattctttaaagaggcatggacaattaattacacgactgagaaaaataatttcccccaagttaattgcacaaattactgtagccctaaaaggttaatgattatcaaacatctttgatgcatagagcctattaaatgccagtatcatttgaataatttaactagagtagtcctttcacaaatgggtctcatccaaaggacaacagtaaatagtgcctttaaaaatattttctctttagagaaacgtgttcaaacccttcagctggagtcaatcttatgggtcacaacacattcttacatttcagaatataagacattaaaacattttatattttaaatgatttagatcatttattatccttatagaactactgaggttttacttgaagcttgtaagttaaatttttgtattttatacagagttagcttaggccgtgattaggtagaaataatgggcagttatcactgtatttatttgaaatgaaacttcttttacagctattcatggaagaaaactttaatattgtattaaagcttttattttatctttaaatgccaactttattatgtatttcttaaaattgatcttccagtattttttatgtatactttttagtgctttatagttattagcaggttccacagtagtaactgaaatatactctgattttcatttttattttataaaactttgatttttaataacatatgctgaaggacactctgaagagtactaatttttttcagggatgcttttccaaaaaggattctgtggttcaataaacttgggaaagactgcgtcctatatgcttttagaagagtcacagtgtatactcacatactgaaggatttgagaaatgctagagcaaataaatctaacgttgtctaacccagtgtttcccaagcttgtctgaagacagacatttccactcttgttttacatcataccctcgaacatcgaaggacttcgctgatttgtgttctacacaaccgtcttgagatacgctgttagattagctgtagcttcccttgccacatcgcgaatttccagcattcaaatgcagcaggcatgtttatctgctgcacttacacctacgtgtacatatgtatataaatataccagtatacatcaatatgtacatttgaagcgtatatgcacacttacataggtacacacatatatgtatgcttgtatttttattttacttactgcagtacccgtagtatatagcagatagtgaaatcagaaaataattgttgagtaaatggatgagagagtttcaccagtctgtggcatacgccctgctgccttcttcaggatgcagaaaaccctgtcccctggcttaaagtgtgacattctggagaaagtagatgtgctctctctagagacacctgaaacatcaaacacaaacagtttgtcagtactgtttcaatattaagtctgtcagagggaaaagaccctgaattttgggtcaggagacctgggttcaggtatggattctaccactttccactcacgtcatcttaggcaagttatgggctttttctgagcctcagtttttctcctctatgaattgataataccttgtaagactgttgaaatatctatagaagacatcaaaaacttatttttaaccaattggaaggtacgctgtgaatgtattatcctgatacaggtgaaagctttattaaaaaacaaatgtaacttaacatttccatttcatatatataggggaagaaaattcccattttttggtgaagatactaattttcataagtaatgaacataaaaaaatatatttttttactgttagcagacaataattttttttctactgtttaaaaacttccatcctttttttctaataaaaaaactccagaatcttcctggattagcctcagacccatcgcacctgctggtctctctgcctggaatcttctttaaaacaaggtgacttgccatttctttccatcttatttcagctctcagtcaacctctcacttccctgcccaccaaaatacagcccccgtatgtatctctttatccctttacctactttattttcctttataattcttatcagacattttattgcacatatcattagtgaggtgagatggagatcatattttgtggcgattagtaagggattgtaatatctctcaataacaaaattgctttagaccaaatttttgtttgcttatatgatttttacacccattatttcagcactttaatgactctgtcagatgtataggttagttagtagtcatacttctgtaaaattctctagtagaatcaaaatacatgtgctctccctttcctctgcatggattttttttttccacatgagggaagctgtggtaaataatgttatagattttcactcgttagtaatattactcaaataaacgatgggaaaatgtttctcttgacaggattgagtaggtagacataggaattcatggaaccacttatgttaaaattgataactttaaaaaaaattggatagcagaaataagacttgttttatgtattagcatccagccaaattatcataactgattgtgtagtgtaaggttagtgatacaaagatgtgcaagatttggttttatactttatctattagaagtttgggtttggtgatacttttaataccatgcagattgcagttttagctatcatgaatttctgaatattttatgtaaaacaaagatgttgcctttaaaagagttaaagttgaagttttttaggctagaatgtgatttagctttatatagctttttgtcagactcttggaatcatttcaaaacacactcatattttgtttagagttaacagagctgtctagaagtaatttctagtttctcctaggctactcatgatgtttgaattattttccgtattctctgctgagagattcttgtggaagtagactttctgagcttctataaacattttccttctggaactatgcccagtccacctgttcaccatttacagggaaatgctgctttcctaatgaaaatcaagcccagattttccagttcagcttctgtaggtagggagtgcagctgtactgggcagcctccagtgagtcccggggacttgacttcttgcaggttttctgctgatggcagctgctatcaccatgtttatcttttgggggactggatgctgctccttcttcaacgttttggcccaagagtagacaacatatgtcataactaacacaaggctgtcatgtttaaagacatctttactgaatgctgcagaggaataaagagaggaaaacccagagagctccatgaatcatgaattcaggcattctaactttagagctatggcacattcatcttcagttagttgagatggttgcttgcatgtaagtggcttttcacatttcaaaaatggtttcccaagtgagcatatgtttactcttggctgacacgcctctgaaccagccccaagttggtgtgcatggtgctagggcatgatttcaggcccgactcatacccccaagctagacacctttgtgcagagtacatctatatgtgtactagggattgcctactgaggtttttcctagttctccctttaccttcagaaggcatagagcacctttaatagccctcctgccttggccctcatcctccctccccaccaacccctgaattcctttagagattcctcatctcctcaaagtccagaggtgggctgtcttctcccacctccttgtaggagctcaccctgatgaaggttatttcatttctgaagctctgtctcctttttggcaactggcaccagcaaggatcagatccttctaaaactgtctcctgtttataacagaatctgacacttccaacatcatgtaagagctgcatatgccaatcacagtggagtttttaatcctgtacccaggtctgttgtgaggataaatggtaattcccattgcatttttgtgtgtgataaagtatattgcttaagagagttctggggatgtatagtggtgatgattacacaacgatgtgaatgtatgtagtatcactgaactgtacatttaatgtttaaggtggtaatcttttgttacctgtctattaccacaataaaaatggaaaaatatattgcttaataaaataatacttgataaagtccatgcagtgtttactacatgtcagtaccattttgaacattgtacacgttgcggtttacttaatcctcacaacaaccctgttaagtagctaatattataatccttatttgacacatgagaaaaatgtgctacatagaagttacataatttgctattaagtgagagaacgagattcaaaccaaagttgtttagctccatagctcatgctgtcaaccactatgttaatacaaatctgcattgtcctaattttattctatatttatgttcagatagaaggcactctgggaatctggagactggggttctcagttctggctctgtgactgcaccacatttgtgactgtgaccagagtagcttctctagtcttcagttattttagttataaaatgagatgggataaggttcactgttaaatttctatttataaatgctgtggatgtgtatatatttttatgtatgtaaagttctgaggttgaataagccttattttctctgtggtctaaaccatacctatggaatctcatctgtcaaacgctatgtgattgaagattaaaaaaaaaatctcatctgtcaaacgctatgtgattgaagattaaaaaaaaaaaaggaaaattttatttgaagagactgggtctcattttgttgcccagacttgagtgcagtggcaagatcatagctcattgtattctcaaactcctaggctcaagcgatccccccatcttagcttcccaaagaattgttattaaatctcatttagaaaagttgaatttctcaaatattaactttgatgatataatactcaccacataagtagtagttgtgtgtactttctagtttgaaacgtataagctgtttcgtgcattagtggagatgagatattaaaaattattccttgacatttttaagagttgataaagggagaattttataaagtatgatatatgtaactatattatattatgggatgcaattttaaatgagatttctgtcacactaagtcaacgtgtgtttatcgagtacctactgtgtcaggcacatgcttgatgctagagtatacagatgataaagagaaggtggcctgcccaaatggagtttacattccagtgggaaagctggtaatcaacaagtaaacaaatgagagaatacaattaatagcagccgtgatacctgctggaaaggaaatagcattatcctgtgatacagaatcactgatggggtcaactttttggtagcgtagtttggaaaggcctctcaggaaatgacattttaagtaaaagctgacagaaggaccacaaggaatgagtggtgggaggaataagggcagatgtaaaggagtggggggagaatagcattctagacaaatgtggaaggctaaataatgttaccccaatgatgtccaggttctaattcctagaaccagtgaatgttaccttcagtgataaaatgagactacagatatgattaagttaaagattttgagatggagagattatcctggattatctgggtgggctccaaatacaattacaagtgaccttataagagagaggaaacaggatatttaactaaagagaagacaactacgagacataaacagagcaaagcagagtcagagaaaatgctacacctctggtattgaagttggaggaatgggccatgagccaaggacaagggagtgtagctctaccatcaccttcactgtcattcctttagactcatattttggacttctggcctctaggactgtaagataataaaggtatgttattttaagccataggtctattgtagtttgttacagcagcaacagaaaactaatacaggataggtgtggtggctcaagtctgtagtccaagctactcaggaggctgaggcaggggaattgcttgagcctgggaggtagagggagcagtgagctgtgatcgtgccactgcactccacagcctgggcaacagaaataaacaaaaacaaaaaactaacgtggaagttggtacctggaggtggggtgctgtggtaacaaatatctgaaaatgtggaagcagctttagaagtggtgattgagtagaggcttgaaaaattttgaggtacatgattaaaaaaccccaggttgccttgaacagactgttcaagtgtttaatgtagatattaaagactgctggtgagggcttagaaggaaatgagcttgttattggtaagtgggggaaagtggatcattgttatatagtggcagaaactgtagctgaattgtgtcttagagctctacggaaagcagaatttgtaagtgatgaagttggctatttaggaggagatttccaagcaaattgttgaaggtactgcttggattcttcttgctgcttatagtaaaatgtgagaagaaattctaactgtggtctgcagcttcagcttcatgccggagggttccagggtgccctttctgacagcctgccctacaaactatactttgaatagcagggttgtagagaatcatatttattcatttagaatgtcaaatatatctctataaaagagtttagctttgctcatcagccttttaaatgtttaccactgacagtgacttcactgatctaattacagttatcgaagccaatattgtaagaactgtgcatcctcttattgtgcacaattgatctggaagcatctttcctataccgagttaaatagtgtcaccccagaaaagttattttcacctatgaatgtgagtttatttggaaattgggcttttgcagatgtaattaaataagatgaggtcatacaggattagaccggactataatccaatgactagtatccttatatgatgagggggctttggacatagggacacatagggagagtgccatgtgcagatagacgcagatattggagttatgctgccgaagtcaataatgccaagtattgttggaaccaccagaagctaggagagaggtggaacaaattctccctttgagccctcaggaaggaaccaaagctactgaaacttgatcttggacttctggcctccagagctgagagaataaatatctgttgttttaggacattcagtttgtggcattttgttatggtagccctaggaaatgaatatgtcttctgacaagtaaaagtaaaatagtggactctaacaaattaatttttaagcacccaacagaaaatgtcactcttccacagagccaatgtctatactatggctgttttccagttttggagttctggaagtttgttagctaccattgctctttgagtaattcttaaaccttttataccaggtcacatttagaatagaatataaaaaccttggacacaaaatcaaagttcataccagatcaagaggggacaaaaatggactagaaggaaggttacataaagtggtactatgtcttctgcaatttgtttgttttcttgtaatatttgccctgagctcaccagcgaaataatagatagactccatagaagtcaactcttaaaaatgacttttctgtcattctttacctccatcctatcaagcacacatgaccttggttccattgtgcaggacttaggaacacactttgaatgtaagcagtttcttctagcattgctggaagtaaaaggatgcctcatcttaaggaatagagttgtttctggaggtcttgcttaagcgtacatttggaagtgattttttttttcctttacgttttctgttgtagaataaaaaatttctttccacaaaggaattattatacccaaaatatgtttaaaaacaatttaaaagtatatatatgtacagtggcactggctttcagagaaaagaataaaagtatatacatgtatcctgttaactgatttttttttttttttttttgagacagggtcttgctctgtctcctgggttagagtgcagtggcatgatcatggctcactgcaacctccgcttgccaggtttaagtgatcctcctgtctcagcctcccgagtagctggtgtgtgccataatgcctggctaatttttgtatttttttgtagaggtgaggttttgctatgttgcccaggctggtctcaaactcctgagctcaagcaatgcacctgcgttgccctcccaaagtgatgggatcacaggtgtcaaccgccatgtttggccaacaactgaaatatttttaaaagtatgtatatcatgtaatatatatatatatatatatatgcatgctacctaagcttaaatgcaacaaagaccatacaaggcttttatggagacaaataaatgcacctgtgtaccacattcatgatagaaagtattagtattataaagatgcccatcatgtccacattaatccataaattcagttctaatcagtaactgaacgcttaaaacctttgcataacagacattttcaaactttacagaagtaaagagaaaagcatgatgaaccccatgtactctagcaaattccacttgtgaccaatgatttcttagaaatgtatcattattaacttatgagactttaaaatacacttgaggtatttaattcatgtcattcgtttttattgaaactcaaattgtcaaatctttgtccaattgtggtgcctttaagttggatcttgtgaccttttgacatgactccattagttttcttttatatatacttttatggtggtaaaatatatatacacacatatagcatagaatttgtcattttaaccatttaaaaagtgcagttcagtgacattcattgtattcagtgttgtatggccatcaccattatttatttccaaaacgtctttgtcatttcaaacagaaactgcaacttctaagcaataatttcccatttcttcctccctccaaccctggtaacttctaatctcctttttgtctttatgaatttgtctactctaggtatttatgtaaaatcatacaacacatatctttttttacctaacttatttaataattttattttcatgatgttttcaagattcattcatattatagcatgtaacagaacttaattccttttttggctgaataataatattccagtgtatgcgtatatcgcatttcgtgtattcattcatttgttgatggacacttgggttgttgcctccttttggctattgcaaatattgctcatgatgaacattggcttacaggtatctgtttgagtccctgttttaaatttttttttttttttttttcttttttgagatggagttttgctcttgttccccaggctgtagtacagtggcgtgatctcagctcactgcaatctccgcctcctaggttcaagcgattgtcctgtctcagtctcctgagtagctgagattacaggtgcctgccaccacgcctggctaattttttgtatttttagtagaggtggggtttcatcatgttggccagcctggtcttgaactcctgacctcaggtgatccacctacctcagcctcccacagtgctgggattacaggtataagccaccacacccggcccctattttcagttcttttggatgtatacccaggagtgaagttgttcaatcatatgataattctgtgtttagctttatgaggaaatgccaaaatgtttttcacagtggctgcaccattatactacttaacagaaatgtttgagagttccaacttttttacattcttgccaacatgttatttttaattttcctttcctatagctatgtgaagtggtatctgtacagaaatgttcattgcagcacagtcaagtgaaaaacaactcaagggaatatcgggaaagagtagataaaactggattattcgcagatcagaatactacgtagcagttaaaatgaatgggctacaagttaaaatgaatgtgattctgttgcattcttcagtacttcagttacatttttcaactccagaatttctgcttgattctttttaattatttcaatctctgttaaatttatctgatagtattctgaattttttctctgtgttttcttgaatttgagtttcttcaaaacagctattttgagttcttgaaaggtcatgtatatctgtttcttaaggattgttcactgttgtcttatttagttcagtttgtgaggtcgtgttttcccggatggtcttgatgcttgtggatgtttgtcagtatctgagctttaaagagttaggcatttattatagtgttcatcatttgggcttatttgtacccatccttcttgggaaggctttccagatattcaaaaggagttgggtaagccatatctgcattagggggcaccctaaggccagtaacactggttcttgcagacttctataggtactgtcttggtagtcttggataagatccagaagaactctctggattaccagacagagatattgttctcctccttttctcccaaacacatggagtcagtctctcctctacttctcccccgaccctcattttgagttaactttgtgtagggtctaagatcatctttttgcatgtggatatccaattgttctggttttatttggtgaacgtattatctattccctagtgtattgccttggcatgtttgttaaaaatcagtggataataaatataagaatttattgctggattcgtaattatgtgccattgatcaatgatttttattagtactataatgctttgatcactgtacctttatataagatttgaaatttagaaaagacctccagttttttttcaaaattgttttgattattctaaatgttttgcattttcatttgcattttaggacctgcttatcaatttctgtgggaataagcctcctggaatttgatagggattattttgaatgtatagatcaatttggggagaattgccattttaacaatattgagtctttcgatccataaatattgaatgtctcatcatttaaaaaaacttgaattttcttcaaagctttataatttttacagtacaagtcttgttcttatgttacctttatttgtatgtacttttttaatgctattgtgaatgtgtctcttaattttacttccagattgtttattgcttatagaaatataattgatttttatatattgatcttgtattatatcctgtgaactagatgtgctttttaaaaattagttctaatagtttttttgtggactctttggggttttctatatacaggatcatgtcatcttcaaacaaagacagttttaccactttctttacaaaccgaatgtcttttatttgtttttcttgggtggttagagcttccagtgctgtgctgaatagaggagatgagagtggacatctgtgccttttaccctgtcttagaggaaaagaatttggtctttcaccaatatgtattatattcactgtaggttttttgcacatgttaccaggttctattctaaggttgctgagactttttatcttgaatgcacattggattttgtcaaatgttttctctgtacctgttgagatgttcatttggtttttattctgtattaatatgatgcattactttaattgatttttagctgttaaaacctcacatttctggggtaattaaaaaagatggcttatcatctttttttatatgttgttgaatttggttcactaatattttattgaggatttttgcatctgtgtttgtgagagatactggtttgtagttttcctttctggtaataatttgtctcgctttgctatcagggtgttattgcatcccataatgagtgggaatattctagaatgagatgtgagtaatattcttaaatctacttcttatacttctcggaagaatttgtggagtattaatattatttcctccttcagtgtttgatgaaattccccagtgaaggaatctgagcctggacttttctttgtgggaacatattttaaaagctcatttaatttttgtacttgctgtagatgtattgagattttctattccttctttagtcagttttggtcattcgtgactttttaggaatttgtctatttaagttgttgaatttgttggcgtaaagttgttaatatttctttgtctttctaatctgtgaggggtcagtggtaatcatctctctttcattcctgatttttgtggttttctttctctctctctttgccaagggtttgccaattttgtttttaaagaaccaccttttaatttttcctctgttgtttttctgttttacatttctttaatttctcctgtcatctttattttcttcattctgttttcccttgatatggtttagtcttctgttttctacattttaaaggtgaattcttagattattgatttgagatttttttctttaatataggaatgttaacactatacgtttttttctaagtcttgtgttagctgcatctcatacacttggacatgagttgtatttctattattcagattaaaatacttgctcattcccccttgtaattttaaaaaaatttttctttgacccgtatttagaaataactgcattattgttggtaaatatactttatacgattttaatccttttaaatctgctaatgctttctttgtggtccagcatatgacttatcttgggttctatggcagcttgaaaagaatgattattttgctgctgttgtgtggagtgtgctttagatgtgtgttaaggtaagttgattggcagtgttataagtcttctgtatttttgttgatcttctgtctacttgttctattcattattgaaaattgaaatgttcaactattgtttctctttaattttgtcagttttagttttatgtattttggacccctgttactgcatacatatttataaattgttatctttacctgctgaattaccctcttattataaaatttccttttctttctagtaacaatttttgtctttaaattcattttgtctgatattaatatagctgtcctctgattactgttttcatgatatatcttttcccatccttttgttttcaactgatctgtatctttgtatctaatgtgaatctcttccagacagcatatggttgtcaagtttatttttctcagtctatactgttaatctgcaccttttgattagatggtctaattcatttatatttatttatatttaatgtaattattaagatttaagtataccttttcattatatgttttctataaatgttatatattttttgttccttcattcctccatgactgctttcttttgtgttaaatggattcttttcttaaatgcatcattcttgttgtttcttttagtatatattttgagttactttcttagtggttatcctggggatcataacaaataacttaaaattcagttcaggttaatcctggcataatttcaaacatacacagaattttttctcacttgcatgctttttttgccttataaattatgtatttatatgttataagcctatcaacaaagttttataattattgctttatacagttgccttttaaaacaaataggagaaaagcgttctcaaaaacaattatattgtattttatatttacctatttaattgcctttattggtactttcaaatttttttcatatggatttgaattacttcagctggaagtaatcctttagtgtttcttgtagagcaattctgctggtgacaaattctctcattttttctttatatgggaatattttaattttcgtttttgaaggatagttttgctggatatataatttttggttcgtagtcttttctttcccccccccagcgctttgaatatgtcacatcagtgccttctggtctttatggtttctaacaagaagtcagctgttaatcttatagaggattccctgtaatatgcaagtcattttttctgttgttttacagattctgtctttgaacattttgtcttaatgtgtgtttgactctttgagttaccctatttggagttcattgaacttcttggatatgtaatttaatgtttctcatcaaactagacatttttggctatcatttctgttgtagtgtttttgcggtttttaaaaatttgttcttagggtttttatctctgcttacattacccacctcttcttgcatgttttacacttttttccattagagcttttggcatattaatcatagttatgaatttctggtttgataattacataatctctgccatatatgagtctgattctgatgcttgctttgccccttcagattgtgtgttttcttgcctttcagcatgccttgtaattttttgtggaaagccaggcatgatgtactgagtagcaggaactgaagtagtaaataggtcttcagtgtgaggttttgtttatctggcttgtaggtttaacgttttctataactgtaggtttaacgttttctgtaactgtaggttttctgtagctgtaggtttttctgtaactgtaggtttcacaggctttagtttcccgtagtatccttgcttttttctcctttattttctttgggcttccctagaaataccgccttaagtagagtctgtaccttgcagctattttagttgtaatccactgttgttctattagagccctgttgatgtagtgataaggtgttgcggagaggaaacattctataatcttgtgataaacctcagatttgtttagtaggcctgagtccctgggctgtgaccttcagaagagtttcttagcatttttttttctcctcttctgtgagacagggatgctagaggggactgagttgtataatcaccttcccctaggtcacataaagttctgacaaagtagtttcccttgggagaaggcctttattatatagaacagaaggctccgggcatatttcaaaatacttttccccagatgcattttggcatgcttacttttccccttgcccttgctgagcacatgatttatttattattttatttttatttttatttatttatttttttaacctccagtcttcaccaggagaacatagtgggacttctgggggtaaaacttatgaaagtgtatgggtcccctaagactgagcccccagtagtttttttttttttttttcctcaagctagtttatactcagcctccagcaaatagtgagttaccacttaagtgttcctacagttatttcctctagtagcgctcctcctagtaagctgtgattttgtgtctccagttttcagtgcaactatttgccctgagacctcagttctctggtgtatctaagaattgtccatgttcaagttttccactatttttcatgttgggagagtgggacttccgagctctttacatgttgcaacagaaaccagcagtattatctcttcagttattctttctctcttcttttaggaccccagttatgtgtaacttcatgcacttggggatgtcccagaggtgccagagattcttttcatttttttttcataatttattcttttcctcagaccacataatctcaatgtatctttgaatttgctgggtcttttttctgctcatttttgtcagctgtggactccttacatgaatatttcctttcagttatcatacctttcaattccagagttttaattttgttcctttttgtgatgtctgtctctttcttgacattttttattttgtgagagttaaagaattaaaggaaagtatgagcatgatggtttcctttaaagtttacgtcttaagttcaacatctaggcttcatcagggacagcttctattgactccttttcctgtgtatggtctgtacattcctatatctttgcatgcttcatattttggttaaacactataaattttaaattatttaatgtgtaaactttggaagttcaaatttgttatccccccagagtatcatcctgttgataaggctgctgttacttcgtatagtgacttctctggactaatctcataaagtttattttcttcattgtgtggggacactgaaatctctgttgggtttgattagtggtcagttgatgattggacacaaatcccttttactaagtctcccatccttctgtgaggggctctgtatatgtgttgtgtatggctctttcctcggcttgtatatggcccggtacatgtgtgtggagttccagatacccactgtggacatctcatttcacaggtctcccatttaaatttttggctggactcttggctgcccaactggtatggccgacttaatagctgtggtgttaatcaattgcagctgattgtttttgacaaatgccctagggtagagggcttctcctgcttggtgagctctgcatgacatcaagtaatgataatgccttgtgaatggggcttccctgagagctgtgaagcaggtcagacagtgacagtgctccagagagggcgcttttggggaagtctgaactgggtctgctccctctggtggctacaggactacacattttcacattgttagggaggctgctggttcttagcctactgtgaatggagcttaggagagagggatggagtagaccaagttaaaatgccatgaaccaagcctttctagccaagattcagcagctttcctaagataatgctttagattgttgtacagctttggttaattttcagaattttcaaaaaagttgattttgaaaattgtggcagcattttcattgtttttatgcatgggagcgtttccacagatcttcactccaccattctgagagtgcccccaacttcgaatggatgaatttttataacaagtgaaaaagtaagtccctgaaggttacatacagcctttacccattttatcaacttagaaacaatgaaaagaacgtatgtacttataaatacataaaaatatacacagtatttgtattacacaaaaatagataaacataaaactataaaaagtaaagtacaggattctggatagtggttacctcagatggtggcagaccaaaggatgggagtgggggttacctagaaatatatgtgtcataattaaggtccagttttattttgtagttggtgggttcatggattcttatggcgtaattaaaaatatatacacaggcaaaaacattttatggttgtgtttgccttcatgttaacacatgagatgaggaatctattatgcaacagagctttataaaggagcttcaacctcagttttcaaagccattcttacggccagaggaattgcttatggagcttatctctacccagtctcgtgtaggtctgcctcagctggccgaactccagtgtcaggacaggacagtgatgatgagaagggaagggacagcagccagtgccagttcgagatgagtagtcatctaatactgcctctgcgtgggtccctgctgccatccgcagcctcatagccctcagctccgtaatgtgtcctgatggatttagaagatacatagggagctgtcattgtgagtctgaaaaatatacagatcacgcttcacttactaaaatccatacttgatgatgtcagccacttacacgagcattcaagaggtcttctagaataatcacatgacaagatttgggggaatacacagaattccaatcaagatgagttgagcataatatcatggaggcaggatcagaatggaaaggtaactgataacttggaagtttaaacaattacaattttcctgtttactgtgtgacaagagcattatggggccttgaaaatggcagtgtcaccactgggtaatatattttattcaaagactttttgagagagagcatctgtagagtcaaatggtacttgccaaactattccatgtatggaacccataggacttcataattttatggtttgctgggggaaaataacaagaccactcatggcccaggtgagtcttgaagaggctgtggccacaatatactgagccagccgtagttcactggatgggaagacccaagtttgacttccagatttacttcttacttgcactttgggcagttacattacttctctgagccttattttttttttttattatggagataatgctactgatgtgtaataattttgtatctactagtattagaatgtatgaattaccccttaatttttcaaatacttaaactgttaacatctgaatcttggccaaaatgagcacaaatggcatttgtataaatgcctagttattaaatgttatcactatttaactatctggatttgaagaccagtgcatggcgtttgctaggagtttatatcatgttcttacgtatgtgtgtagctgtctttactgcatctgtcgattaggaggtaagaacacctgctgaatatgtaccttgagctagctattgtgggagatataaaagaagcacaaaactggatcctgtcctcatggaactcaatctggtttctgaggtttagcttttatgtgactcacagatagagcaatgtcacagaaaataatatgcggaaaataaatgcaaaaagaacttgagaaagcttcatgtggctcagtatcctgcactcagtaggatatgtggaggatatatataaaatctaattgagattcttaggaaaggctttaatgaagactggagaatgaatgatatctgttataaaggatggtgaagcttggctattcagagagtaatggaggaggtacttcagtagtttttattgtgtctgcccaagaaattcactcggaagcacaatgtttatttctgaagaggcaaagaccaagttttagaaaataaagttctcctaaatactattataaagtttgagtatttctattatgattttatgacttcccatctgtggtaggtgttttattgaaattatttgaatgttatcaagctgtgacaacaatgctttaaaggtcatacacaaagcacaattaaatttcccaagtgaaataagaatgtgcattgtgaaaggcagagaatttcaagtagttcagttttgttgttgctttttttcatctgggccatttttgaggtgtttaaatcaaaaagttgtttttcttcttgattgcagttttcccttagttatttgtgtagcttaaaaatggaaaccaatgtgtttaagttgcaatatttttgagtctattagttaatataaactttattctacactcaacagtagattgcattatagctatgtggaatgtaaagattattttgcacttatataaatgtgatagcttctgattgatacagatttaattatgcaaactttggcttattatgaattagatgaaacatttctattcctctgtttctttctttctttctttttttgagacagagtttcactctggagtgcagtggtgctatctcggctcactgcaacctctgcctcccgggttcaagtgattctcctgcctcagccttcccagtagctgggattacagctgcatgccaccacacccagctaattttgtatttttagtagaaacagggtttctccgtgttgatcaggctggtcttgaactcctgacctcaggtgatctgcccgccttagcctcccaaagtgttgggattacaggtgtgagtcaccatgcctgacctatacttctgtttcttatgagcttacttattagaagatctctaagattcctgtaatttaaaattttgtaatttcatttcattttacccatttacatcattaaagtgatgaatggttgcttctttcaaatggtgggaaatgaattttggagaattgttagttattattgctcatttaaggttatttgaacgttttgactatttgatggtgttttttgtttgatttgtgatgctgactcataaataccatgaaaaacaggtctttttgttctaaccgaaagagggattatttagcagcttaatgactttggtaaataaaagtttatttgcacctatgagaaagatgacaggtaatatctagatatctgagtaaagagtaaagagagcacaaatacaataagatatggagactcagtatcctatcagctttttgatgtaaaatggtacagtagttactacctaagagaatagtctatttccatgctggttgctcacttgtgtgctcttctgaaagagtgagggcactgtgcgtctgactggatactggggtactctgtttccaagctgcattacagggatttgaaatatcttacatatatatatatatatatatatatatatatatatatatatatataatatatatatttatttatattatatatatatttatttattccatatacaggcataccttggagatattgcaggttagggtccagaccattgcaataaagtgaatcacacaaattttgtggtttcccagtgcatataaaagttgtgtttatgctattttgtagtctgttaagtgagcaatagcattatggctaacaagagtacataccttaattaaacattttctaaaaaatgcctgcacagagacgtgaagtgagctgatgctattggaaaaatggcatcaatagacttgctggacatgggctgccacaaacctccaaaatttgtaattttacaaattaaagccctcaatttgaaaaacataatatctgtgaagcacaagaaagctaagtgcagtaagacaaggtgtgcctatatatgtttctgtgtatatttaaataacttatattaatagctgcaaacagtagatttcttccggtgtatggctttgtcattgttatcactgatttgtaataatttacctcttttttgtatgttttattattttctgccatggttgataaacaagttaatttactctcagaacagagaatctgcagtattattattaatagtgactgttgacttcttttgtcatctaaacaacttgttagtctgcccttaggcttgacattatttttgttgtgaaagaatattcagtaaaaagttttgacatgtttaaaatcattaaatacttccaaactggtttggaaagcttctctgggctgaaagccagttgattcttatcagtctttttgcatgactgaagtcaattacttcagagcttgaacaactgcagccttggtaaatggtccagtactgtccagtagtacaatatgggaggcttttaaatgctactgtaattggtagtttaacagatgtgttttggttggacaagaatgtaaaagctattttggagcattttcaaaggcatgaagtttaaaataatgtaatgttaattttgtgctctgtaatgtatatcgtaagattgaggtcttaatgtttgtattaagtaagtgaaaatattcaaatgaaacttgtgtagaaaaggaactgcctgtgttcagaaagattctgaacaaaaacaagtgaattttcagaactgaactaacagttgccagagggtgtgggttctgacgatgtcctacctgaggcaggctttgtgactttggaaagccttggttttcttatttttaaagaggatctagtccaacactggtctactcagacttcctcatttgtaaaaaaaaaccaaaaaaaaaaacaaaaacaaaaacaaaaaacactttccttaatcttggaatgcttttcacaagaactaagtgtggcatattggtggctgtatgagtactctggtattataggagttgaagtgtgaggtggagagtaagagtaactgggggtaaaacttagacccaatgtgtccagaagattcagagccttatcactgcacaaaggagcacagattttaaacactgaagtgcccaagttgcatgcaaacaggctgtgggctgaccaccggtttttgtatttattctgaatatagtatgccacaaaatttgaatgtatatgcttttacagatctctgtgctctctctagctcccccaaaatctctgcctgtctttagtttcatgctagactgttttatctgtttgttgcctttgaaagcttttgggtttaccccatgctggagtaacatgtagatctagaaggattttgagcaggaggtagtgttatcagatatggttataaggaaagctcactttagcaatagagctgacacagtagtagcaggtagtgaattctgcaagagaattaatggacactagtcatcttgattgtacttagttatttactgcttcagtgtagttctgttgtgcttaattttcttttcttttctttctttcttttttttttttttttttgagagagtcttgctttgtcgcccaggctatagtgcagtggcatgttctcagctcactgcaacctctgcctcccaggttcaagtgattcttctgcatcagcctcctgagtaggtgggattacaggcatacctcactatgcccagctaatttttgtatttttagtggagacagggtttcgccatattgctcaggctggtctcaaactcctgacctcaagtgatccacctgccttggcctcccaaagtgctgggattacaggcgtgagccaccgctcctcgtctgttgtgcttaattttctaaacaaactctagaacaagttaagtggttaatccacgtgatttttgttctcatttaaaatcctatgcattcaaaatgtgaactccattaccatctctctgatccgcccttggcatagaatttggatgtgtatattacactggactcttggctttaaaaaccgtctatctgtatctgtgggaaagcttttcagatagcccagacaatataaatagccctagatttacccttaagtaacaaatgtgtttctttctgtggagttactcgttgtgtctgagggatcctccctgggttatttttttcctctccaatggactggcttggcatatgattgtcaagaacaggcactctggtcggacagaccttgtttaaatcttctctctctctccaactgtgggccagttcgttaatctacttgagctttggttagttattctatagatcgttttgtggattaagtgaaacatcatactgaaaacacttagttttatcatccagaccagggcactaaacgagaataaaccaacctcctagtttttggatgtgtttgacacgaggggatgtttaggggaaaataatatttgaccatcagactttttgaatgctggagaaagcatgcacaatgtccatgtaggaacatacccatatatacaggagacttaaacatgtgcgtgtatacatccatatacacaaaatgaatttaggaagttaattgaatcgaggagtttctattttataagataaatgtgaacagtacatttgtaatgtaagcagtctacttttttactcaaacaagcagaaaatatccttttttagttttaaactctttgtagacaagattgaataaactagagtggatgaggcacagagaattggttgccaatgggatcaagaatgctagaggaaagggcagagattatcctttcacccagaattgctctgtctctcccttactaggtaggaaaacaaacaaataacagagacaagggctactgctctgcactaatgatgcgtggggtgaaagaagtccttgcacactggctcctctttcctgcttcgttcacaacctattcagcactttctggaactttgcgtgaaaaatttcatagatcccagcaggaattttgtaaaacacataatctttgctcatagccattacccaatgttgtgttccttcaggggctgattgaaaacagagctttcacaaggtctcttgcatgatgctagccttcatggcatttgcatcctgccaagtgatacttctggtgaccatcctgccaagtgacacttttggtgacagtgccttggttgactggtctcagcaacctgctttaatctctgcaattaaaaggtatgaatgagtgaaccagtaaaatgaaggaaaaaatcaacatagtggcgggatacttacatccagaaatatgttatctaagggtgtgatactgggcagccagctttcatttaagaaattagacgtatttttaggaaaccagctttctgctagtgacctacattataaaatattataaactcccaagctggatactataaattgaagatgaagttctttcattttgcagttacacaatggaatattatgtgtcaggtactgttctaggcattgggtatacaaggataactaagaatttgtccttctcctcaaggagttcccacttttgtggcagagagggccttgaaaacaaatcatttaactgccacttactgagtgactagcacaggtgaggcatcctaccaggctctggagaaagagggaaatatagccctgctctcagcaaacacaggtggatgagaagggtataagcagggggctgggaagcagagagagagagaacctaaaaagacttaggcaaaggcgagtgtatgataaaatggagaacgccatagttcattctttcatttttttttttgaagtagagtcttgctgtcacccaggctggaatgcagtggtgcggtctcggcttactgccacatctgcctcccaggttcaagcaattcttgtgcctcagtctcctgagtagctgggactacagatatgtgccaccatgcctggccaattttttttttcataattttagtagagatggggtttcactatgttggccaggttgatcttgaactcctgacctcaagtgatatgcctgctgtggcctcccaaagtggctgggattacaggcagaagccatggtgcttggccagttcatcctttaattttggctctaataaattcactgtatgactaaaatgttactttttcttgatgttattattaatcctgtttaaaattagagcattggctttaattatttttaaatttagacactggttattatttctaaaggaagttataaacaaaatttcatacagcatgccatttgacaaattaatgaagaaatatttaatacatgtgagtatctcatttgttttgttattcaaggggattttagcttattgctttttgctttctgtatgttgaactgatattctttttgggcacctgtttgtataaacgtatcaatttgacctgtacttgaattaactgtttattttttatatgttggacagtactacaaattgctctatttatgaactgtatgtttttcttcaatatgcagtttggaatcctgctgttggaaccttatttgcttctgtatgctcacccttattcactaatgtttgataataatgcattataaaatagcagtgctacttctttatcaaaggcttgcagtatttatttagcatttgcagtttcgaaataattaaacaatgctgatgtacagttcttattgcatttcaaaaacctaaccagttaattagcttaagtggttctctcagccctattgacagttggagacacatagtgctggcttgtcaggctgctaaaatgaaacataagaatggcataactgtggttagcttcttttccccctcacccttgagatatgagttggctttcttttgtgtgagataaaaacaaaaccagatcatatgaactgacacttctgcttcagattaacatgagccttgttattcaatttcatgttggtgtttctacactcctttgcctcactgagatttcattaatcctcatatccttaatcgcctcccctttcccttatgatggtctgttttaagattctattatggttttttttttttttttggatgcctttgaggccatctgaacaatactcttggttaacctgagaatggattacaatctgatcacatacttactgctgtgtttgtgtctcgctgcctgtacagtcaggtggctgttctgcctcttcacccttggctgactttcacccatggactttgaagtgttactgcttctattttcatcaaattttatacaaattacaccgtttttccgcaaatgtacatttagtgaagtttgtttggctccagaatccagtccttttgcaggacaggagcagaggaaatggcagtgaaggagagggaagtccacgtaggaagaaatcccaagactggaggtggattggagacagcaacagaagagaagagcgttggggatggctctgagttgaagctaggtgactgttgacccagagaaagaagttgagaggagaaccacgctttgtatttaggtgggctgtggtggggtggaggggattgaggtgtggagtttgatttttgacattcttgtgtttgtgttggtaagacaccttgtggaactctcctagcagagtttaagcgaatgagcgtatatatttgatgaggtgtatatttgagagtgacagcacagaggtgatcataacaggagccactatttgttgagtgcatactagctacagtgataagtgcttcacagacatgctgtctgtgcttcaatgtcctcacctgtaaaagggatttaatagtaggattcttgtgagaatgaaatgaattgatatatataaagtccataacaatgtctggcacataataagtaatacttaagtgttatcataatcacattttaattcagtatccctttggaaagaggtattattgcaggttgaacatccctaatctgaaacattttgagcactgacatgacacctcaaagtggaaaattctacacctgacctcatttgatgggtcacagtcaaaacttcatttcgcgcacaacattattaaaaatatataaagttagcttcaggctgtgtgtaaggtgtttatgaaacaccttatgaattgaatttcatattagacctgtgtcccatcttcaagataccgcattatgtatatgcaaatattcaaaaatctgaaaatatcagaaatcaatcacttctggtttgagacgttttggacaaaggatactcaatttgtgtacacatcttatatgggggaagctgtgactggagcaatgtaactactctgccaaaggttgcataactcataagtggcaggtgaaatgatatctttttttttttttttttttttttttggagaaggagtcttgctctgtcgcctaggctggagtgcagtggcacgatctcagcttactgcaacctccgcctcccaggttcaagcagttctcttgcctcagccttctaagtagctggggttacaggcacacactaccatgcccaactaatttttgtattttcagtagagacaggctttcaccattttggccatgctggtctcgaactcctgacctcaggtgatccgcctgcctcggcctcccacggtgctgggattacatgtttgagctaccacgcccagcccaaaccatattcttaactctgcttgtctctcacctgcctttgtggaaataaacacctcaacagaggcttcatggtgtagaggaaagacaggacaaaatacctaacacacaaggaagctgttttgcttattaaatgaacaatatgcttttaaatcgtgtaagaagagctttgtaatgaaaatcatcattataagaaagaaaaacttacagaaaggtaggagtgaggcttggtatttgagctcctgcggaagaccaagagggagaagggaagatcagtgtagggcaaagcaaatccaagagagccgggaagataagaggaagaatcatgtagtttctgcatttacggacaaaagcgcttccaaaagtacataagggttgatgctatcaagtgctgcatggaggtcattgagagtgagaactaagaaaaggcagttggagtcacattttggtgttaaccagattaaatttccttttggagcaaaaacggttgactacacatacagttataagaatcaggaacatatgatccaataacatagatgaatcaggaactgaaatttggggtgtagatttattcctttgactttctctccctttttcagttcatgttttaccaatagagtattctggtagcagcactgtctgacatttgtcagcttaattagagatcagttacaaacttggctatcttatggatctgtgatacttcccagcaaatctgaaatgcaatacgggcactgacatgaaatgatgaaaaatatgctaattttaacctgaaaaagctccctattaatgcagcaatttctcttattcatactaattctcatttttttttctgcatcctttgtgtctagtctctccacaattgaaaagctgttttgaccaccacttaagagcaatagactataaattctggagtttaatttgtttaatgtctgtgagggcttgatggggttgggactttgttcactaggtatgaacccattgcctagaaatctgaagaagggtatattgcaggttcttacgggtattcctaggaagaagaaatgatttccaaacagaattagcatgtagaggagaaacgcacaaagaaaaggagatttgatttccacaatgtaaggaaatgtaaaatttcattagaagaaagggaaagaggacattgccagcaaagatggagagaaagaaggcgtgtttaaataagctggtttccaatttagctgaaacatttgaaagtaaacagaagtagagctagatttaggggtgtaagatgtgggcaattaatacatttatatggctcaaaatttgaagagttggaaagcatctacagtgaaaagccccttttcctgccccatttcctcagccactcaggctattccccagagtcactgtgcataattacatatataatacaaacatgtatactatttctcttccctcttttatttttccaaaatggtatcaaactgtatatattcttctgcaccttgccttttttctcactcaacatgtttcttggagctgactctcaagcagtttgtgactatgtaattaggacataggcagctcctgctttttttgttaaatggcactgcaaaatgttcctttatgtgtttataccataatttatttaaccagtctcttgttcatggacattataaccttttgctcttacgcagagtgctgcaaagtgagcagtcttttccacgtgtcatttcacacatgtgcaagtaaagctgtaggataaattcctagaatggctggattaaaaggcaggggcagttacgattttgaaagatgtagccaggtggccttctccataggttgcgagtgtatgaaagacttacttccaagccagtctcttctatgctgcctgctataactaccaattaggaatttatttgggctaataagtaacccatgcctggaagatttaaggaatgtgaccttcctaatgcatattatttttaatcactgtgctttcaacctaatgaccagttgagattaagccacgtggtacatatttattgcaaacctactatttggttctagggaatcagcaaggagcaaggtgttacttctctcttggagtttatattctggtaaataaacaagattattccagagagtgataaatactgtgaaaataatacacatgacaatataattgtaacttggcagggggcaggctaattagaaggagtatactggttatggaaggccccctgaggaagtgatatttcagctaaacctggatgatgtaaaggagccagaaatgtggaaatcttgggtggcagtagcaggaacaacaactgcgaagatcttgagccaagagtaggcctagtggttctagaaacaaacagtagggtagaatagcaaagggactatcatgagcagaggggagcagggcatagcctgaagctaaagaggggcaggggtcagaccaagtagatcctcactgtggtaaggagttgcaagatttcaaatatggatgtgatgttgagatttacttgttaaaaagataacttggagccaggtgcagtggctcacatctgtaatcccagcactttgggaggccaaggcaagtggatcacttgaggtcaagagtttgagaccagcctggccaacatagtgaaactccgtctctactaaaggcatgaaaattaggcatggcggtgggcacctgtaatcccagctactgggagggctgagacaggaggatcacttgaacccagggggcggtggttgccttgagctgagatcacaccactgcactccagggcaacagagcgaaacttcatctcaaacaaacaaataaataaataactaggaggctgtgcatggtggctcacacctgcactttgcgaggccatggtgggaggatcacttgaggccaggagtttgagacagccttggcaatgtagcaagatctgccatctctacaaaaaattaaaatatcagccagatgtggcacatgtttgtggtcccagctacttgggaggattgcttgagcccaggagttcaaagttgcagtgagcagtgattgcaccattgcacttaagcctgggtgatggatgagaccctatctctaaaaaataaaaagataacttgggctgctgagtggagaatggattgggagggggcaagggattaagtggagagagtatgttttgggctgggctgtagtggcagcagcagagatagctatgccttggaagacatatttttgcagaggtggaactgttaggatttgtatgccttatgggtgataggcagaaagaggaatcaaggactcctagaattttggcttgagcaagctaggcatagaggcaggaagagacaaggttggggtgcggaggaggaggagaaatttgaagggtcctagggcattttctgagacgagtggcctggagaatgtgacggaatggactgtttggcccagcccacggaggaggagagtgctgggttttagaaatggggcatctgagaaccctgacttctgtcatggtgcctggagtctaaagtggggagcagagcatccagcgaaggtgggtagtgtccgaaaatctggagaatgtttgtttctttggtatgttttagtttttttcttttacatgaatatctatagatcttccttgatcacaaaaaatgaagttggcaaatttatggaactgtgaaagtaataccttatgtttttgtgaaactttgagagataatttgtctactataaaatttatttaaaattgcacaattgtgatttttcacataatcgtaaggttgttcaaccatcaccactatcttgactgcagaacatttttatcaccccagaaagcaaccctgcgctcactagcaattcctcctactcctccattcccccagcccctggcaaccgctaatctacttgctgtattctggacatttttacaaatggagtcatataatgtgtgttttttttggtgtgattctcttctttcacttaaaataacattttaaagatgcatccatgttgtagcatgtgtcagatctccattcttgatggctgaaaaaatatttccgtgcacggatataccacattttattaatttatcagttgatgaacatgttggttgttttgacttttcggctattatgcataacactgctatgaacatttgtgtagcagtttttttgtggacacattttctttcttttggttatacacataggagtgtaattgctgggttttgttaacttgatttttatcttttgaggttgtatccaactttatatcatttatttatcacagtagctatgaaaggaacctgaagtactgaaggatttgatgggctagaggaaaaagtgcatatgttacaaaaaatatttaaaatgaggttcattcatgcattggttaaaatagggcagacctggacacataaatgtgtcaggagaagtaaacaaaacgtgtaatacttatatagtggaagagtgtattgcaggtgtatgtgtgtagagaagtgtgtagagaagttatatctatatgtaatctcaacagaggtagataaaaaacaatgagaggtaggttaaatgagaagtagattaaaaaacaacggtgaaaaatgattaaaaaacaatgatgagtgaataagtgagttgataccatttatgtaagttaagaaaaccacaaagtaatactatgtattgctcatagatggaaatgcccatatacacacacagaagtacaaaaaggattggaaggatacccacaagtccatgatagtagttgctttgtatccctacttctgagctgcaaacccatgccagttttccttaccatatatttatatataaattatatataaatgtatatatatatattcatatacaaatcatttctgttacatgactgtacatttcttcggagtagggactatgttttcttcaccaatttccattgcctagcacttaagtgtgaacacatatttttgaatgactaactgaatgaattaaatgattttgggaacaagatagggcaggactaatgaataagccactctcccccatcctgctcattgtctctgctccctaccttcatattctgttagtgttgtcataatatgaggcttgcaattaccagagcagttccatatgacacgacatgctaataaagcagatggtgtgtgcaaataagcaggataaaagaggtctttgctgcaaaagtcattgctgtctcctttaaagtatgaagtattttatgatttctcagtagattttatcttcattgtcaaggtaatgattatggatcgtataaatctttatggctttgttgtatcaagtgtcaaattacacagcttaggtagttgtagaaagaaagatgtctgtgatcagattaggaagtcatattactaaaagtttttgccgttcagggaggagttggtctcacttttttgtgttcagatagtggagaactgtgctcccgttctagggccctccctcctttctctttattaacttctccccacgggagaaagaatggcaaattggaaagctcggggcttgacattaatatgagtgaagtcactgtatttccacatggctttcgttctttttttttttttttttgcgggggaaacaaggggtggaggcctgcagaaaggtgccagctatcctctactttttgcctgctgtcttcaggcaataaggagattagggaggtgttcccctggcaggcctaatctggtctatacttcttctagtccagcctttgcctggacaggtaaatcagttcaggtttgctctgtgaacctggccaccttcaggtctggaagaagaacataggaagccctgctgacgtcaggcttaagctgtattctccagcacatttaccagaagcctctggggttgtgtgtgaccatgcctcgaataaagcccatgttctgatccccatctgtctgtcagatgttatttgtggatgttatttgtggttatgcccagttggttagaacctagaaagtgataaaagtgagccatgcagccgggcacggtggctcatgcctgtaatcccagcactttgggaggatgaggtggatggatcacctgaggtcaggagttcaagaccagtctggccaacatggtgaaacactgtctctactaaaaaatacaaaaattagctgggcatgatggcatgcgactgtaatcctagctaccgggaaggctgaggcaggagaatcccctgaacccaggaggtggaggttgcagggagccgagactgcgccactgcactcaagcctgggcaacaagagctaaactctgtataaaaacaaaaaataacaaaaaaactagcgagccctacagctgcaggctgaggttctagttttggcaataagctaaagtgtaaataattttacatttaaaactatggaacaaatagaggtgggacatgggctgcccctgcccacctctccagccagttccccgactcttcgtcttctttctgctgcatgtggtctgaccatcttagttctcaagtttgccaaactttttttcagccatgtgtcctttgcctatgctgttttctctgctaactttctcttttttttctctctcttacttgctgcttttatggtcaagttctaactcttcaagcgtacacttaaatagtaccttctctgaccccgtaggctaggttgattgcttcagtgtactaaggcaaaaataccctgagtatctgtgctcattaacctctgtgtttcccttttgtaagatttatcacaattgtaatcaaatatttatgctatgatatatttgttgcctttctagattttctaacagtcttctttgcattgttacataaagtgtttagtgcagagctgggcactcatatttggtgcctgagggagatttgttgagtgaataaaatagcagtgtccagcagcgacatagactgctgagatatggcatgtcagagtctgaaaggcttctgtccagttggcaagtggaattcattggatgttttacaaagaatagttttagtaaggtggtggggacggaagtgagtttgcaaagtatcttataaaaagctagacttaattactcatttacgcaacattggaacccttacaagtgatttctctactgagagcaacttttcttgagttttactaactcagtagacactgtcagaatctgccagattacaacaaaggggtaaaaattcctgatcacttgaggtcaggaattcaagaccagcctgggcaacaaggtgaaacccgatctctactaaaaatgaaaaaaaaaaaaaaaaaaaaaaatagctgagctgggtggtgcgtgcctgtaatcccagctacatgggaggctgaggcaggagaattgcttgagcccgggaggcggaggttgcagtgagccgagattgcgccattgcactccagcctgggcgacagagcgagactccatctcagaaacaaacaactcccaaggcattatactatgactcttttctcaatgggtagtgaacagaatggaatattcacttcactgcaaagagtcactggcaggtggtgcagagcactgtgctccagaaagagcaaagagcctagaggtttctgatctctgcttatcactcagccaaaagtacagtcatttgcttaaaaaaagacaggtggcataaaaaaaaaagtattctttaatctctctgctctacaggacttgaaacatagccttaaatgactaagtcttcacgtgagcatgacataacctggaaatcttcctataatggaactggccttgtgaaggtatttattgttaagactttccagggtatattttgggaggtgccatgggcagatacatcggcgatactgttacatagtccaggatgttctacttttgaaaattaacaataattacactcaagaccttaggcaagttgactattctcagcactttatatatacagtcgtccctcattgtacaccgggatctcccctacccctcgcctatggtcaaatctgcacgtactcagtcttacagtcagccctgaagaactcgtatatgtaaaaagagggtatctctaggcagtgaggtagctttctgttagctcttgtagggaccatgttcttgtggacttgacaaagaatgttatatcaaaagtcgtaactcctttttcctgatttaaagatgacatttacatggtttttgtgtcccatgaatacggtatttttgatctgcatttgattgaaatgcatttgagctgctcagttgaaacctgtgttgttcaagggtcagactgtattaacctatttaatctttgcagcaaatcctgtaaggaatcagtccttttacagaggaggaacctgaagctcacagagcttaaggactttgcccgaagtggcagaattggcatttgaacctaggcatcctggcttcagaatccatgttcttcccttttaggttatactgcgtctctgtggccacttgatgataaagtcagtaattaggatccactgttgttccctcttgtgcctctgcccttttgctcatgttctcctccctgacactagagcacctgctcccccttcacctgcagtgagtgtctcggggaaacatcagcacagaggctctgctttctcccacccggcaggtccgcagggggttgctgtttcgaaagtattgagtgctctggacaccatgatctgttctgtaggattcttctgtagcaggagctttgtcatggactcagttgccttttgaatgctggtcaggtatcctagtcatctttcacaatgtcgatcatatgggaaaatatgtttctagttctgacaactgaattacatgtacacctttggaacataatctgtttttaggttgagaactacctgtgtattcatcaagtactgaagttcccagtgttcaagaaatgccctatgctattaacagagaattaacaggtttctctaaagaacaaaactaagcttagtatggcctggtattaatccctgtctagaagtttcacaatcaaaagggcaaaatgtggaaaagcaaagataaataagtaaaattggaaaatacgcaaagccgttagagatgtaccagtggctcagaagtaggtaataatgagaaatgcacccaacctctgtgactgtgaaacatgccacccaagctttgggtttttgaaatctgtctctggcacttgaatctccttgtcagtggcaaactggagagctttccatacttctgtgcaaaggaaagcataccccagagcaaaaacaaaataaaatgctacttaatattcaatgtggtgtcctttgaatttaaaagttgtagtgatactattatagcagaattaacattattgtcatattagcattggaactttcccatttatttttggcttggtgaatttgaaagtgttgtttaacagaaaagattttaaaaggttagatgcaatagcatttattttgcacagtttgatggattgccagcagcagggaaaactacaactcagatcgtttcaacaactttctgttcttggatttttcctttctcaccaatttttctttcagagcaataatcattttactgtatatgaaagagatacctaaatatcaggtatctagttaggtgctaatgaactcctcctgcccattttttaattgtttgctttatcatagctctaagtagtcgtgctaatcttttagggggagggttaaggaaagattttacttaattttgggatttactttgtcttttacagagcttgatatgtggcttaacagtaagtaggattatagcaagttgttattttagagaaagtaaacgttatctcattatattcttttttaacataatgagaatctttatggaagaatttgcgacagctcaagaacattttttaaaatttaattttaagttccaggatacatgggcagggtgtgcagagtcgttacatagataaacatgtaccatggtggtttgctgcaccgattaacccatcaccaagtattaaaccccacatgcattagctatttatcctgatgctctctgtccttccacacctccctgataggccccagtgtgtgttgttcccctccctgtgtccatgtaagaacagttctttttaaaggttagtacttggattgttttattgttgtactgtttaagcagctttgttgagaaagagtaaattaaagcttttatcaatttttttttttttaacagcaaatctgtactctccttttttttttttttggtggcccaggctggagtgcagtggcgtgatcttgtctcactgcaacatttgcctcctgggttcaagtgattctcctgcctgagcctcctgagtagctgggactgcaagtgtgtgccaccacgcccagctaatttttgtaattttaatagagacagggtttcaccatgttggccaagctggtcttgaattcctgatctccagtgacccgcctgccctcctcggcctcccaaagtgctgggattacaggtgcaagccaccgagcctggcctgcactctcacttctagttatcaatgttaaatttatcatttgtcactaaataattatgatattcataattaccaaagccttttaaaactgcatttttataatttttgctacttgctgatagaagaccttttgacttaaatatctaagttttagattgacattagttttgatatataaggtttagttttcagtattgagctgctatctgtaaactaattatattttgaagtgaaattagtggagaatggacattttctacattgcgtgagcgtctacagctagagagtatctctaggcagtgaggtagctttctgttggctcttagatgggatcacattctttgggcttgacagtggatgttatgtcaaaagtcataactcctctgatttagagatgacatttagagtactgtaggtttatgagaacctgctcttaaccttaaataacagagctgctgccagggctgctgccttccttcctggtttttgggtgcttgagactcttggaaagtgggccagatgcagtggctcctatctgtaatcccagcacttctggaggcttaggcgggcatatagcttcagtccaggagttgtgagattcttggaaatgtaaagcatagttgatgagagggggaattaaatagcagaccggatggttctcaaaataaaataggaaattagaagatatgaggccttaataacaacaacagcaaaaatgagatgtatctatctataatgagatttctgaatgtcataatacagagacaattctgtatccaattagaataaaacttgttaccttcaagtggaatgaatcaaatgcaataattctatacccagccaaactactcttacataggtggtcagaggatcaatatttaaaaacctgctattattctaactttgaatcctttcaggaaaaaaaaaatttagaaaatacttaaggcattggtgaagtcaagagtgaaaacctcataggaaagaatatgtggcttatatgcaaccgattaacttgagtcaaatctaaataaatgttagtaggttgtgaagctaagtggattcattgacatgaaaaatactatagaatataaccaacttttcttaatactggaagtccttttgaaaaatcaaattattgctgggtgtggtggctcatgcctgtaaccctagtaacttgggaggctgagggaggaggattgcttgagctcagaagttcgagaccagcctgggcaacatagcaagaccccatcacacacacccagaaaacatcaaattatttctttctgtagctctgagtttatatgcatatctaatgaaatgattgaaaaccctactctggcaacacaggagttgggctggcgataaaaggtgggggaaaagcaggagtacttaggatgtgggagaggaaatgatacaaatatgatagactgttaattcctgggaaaaataccagaaacagctgatctgattttcagaagtaatcataaaaatagatagcatttattgaatgttgcaaggcctttgctaagtacttaatattgttacctcattttaccctgtatatcagagatattaatgagctggctaatttatatacctgtagaatgtgtaatgaacactcattagcattatagatatgttagttttaaagtgtatctgtgtccttttaaaatatttccttttaactcttaaattgaaaagtctagggaataatcctaatcaagaaggagttgcaggaaactattgtaaatccaggttgtaaagagaaaataaattggttggtgagaactgtcaccttttccataagataatttaagcacaaatgattacaacaatttacgttttttattgtggccaatatagttgacttggtttaaatcagacaggagaaaagaggaaaatttttattgattaaccaggccctgaattttctgtcttaggaggaggaaattatgtagttaaattgtatgattcctgtcaaaagaacaatgaacttttgagcagattggctgagcagagagaatacaaagcagggctaatgattgtcttcatcaaagagaacttcttgggataagcagatttctatgcttttataagatagatttttttgggggcagtgagaatataaaaacaaattcgggaatgagaggttaatcgataaagaacctgagttgtgttttagtcatggaaacagtggcttttttttttttcagttttgtttttgataaaaagtatcctaaatataaaggaggtatatttccaggtaggactgtgctatgtaactcagtagtctctaaactgattttagttttgcttttgatatctgaatggattaggaaaattccttccaagaaaccagagaccagaagatcagacaaataccatatcagtttctctgctttgaaaattataattcaaccttgtaaaatttttctaacgttgtgttctctgtaaataacacagagtaaaaataagtcaaaccatttgttttttcctctaaatgttctgaacattaaacaaatggttcttggcaaacacatactattttttttttttttttgagatgagtctctattgcccaggctggagtgcagtggtacaatcttgactcactgcaacctccgccttccaggttcaagcgatcctcctacctcaaactcccaaatagttcggactacaggtgcgcgccaccatgcctagctaatttttgtatttttagtagagatggggtttcaccatgtttgccaggctggtctcaaactcgtgacctcaggtgatctgcctgccttggcctgcctaagtgctgggattataggcgtgagccaccatgcccggccatactaatttaattttaggaatgttgtattatagttcattttgaacaaattgtaagaagattattttgtgcccatatgtgtgataatcagaatagcttgatgtagatatttggtatctttttagaataattatgtttagataaatcttttctgtggaaacatattcctaaacatttaagcctagttataccaccctcaaatataagaagtttatgaactttgtgggctgattcaggaaatcttttcacactgataaaaacaggagactttaatattattttgggaagaaaaatgagaaatttgaagatatgtctcttatgaatcttgctgcatcagtttgttttctgctgatagtctggttgatgcacaatttagttttcaaagaatttctcttcaaaaataccggctaggcacagtgttcacaccggtaatcccagcactttgggaggcagaggtaggaggatcgcttgaggccgggagttcgagaccagcctgaacaatgtaaggagactctatctctacaaaaaataaaaaaactagccaggcatggtggcgtgcacctgtagtcctagctgcttgggagactgaggcatgaggatcccttgagcccaggaagtcaaggctgcagtgagctatgatagcactactgcactccagccttggtgacagagcaagaccctgtctcaaaaaacaaatatttttcatccttggaaaaataaaacctaaaataagaagagcagcacaatatttttcttttttttgaagtagcagggctgaccaaagccatttctagccaaataaattatttattaatcaatatcgttaccacattctctatgtggaaaaagtattcaaatcttgaggcctatgttttttcaaacttgagagtcatacagttgccagcttttttttttttttttaagtagtagacaaattgtaagaactacaaaactgaaaattaccttctgtttttcttccccataagctgctgttgaagtgaagtgagctcagggagacaggcctgttgttatcttcctatggcactgatttacacttttacagaagggaaatttatggcccttatctgttgaggacttttatgaatgactggtataaatcaagaattgaatgaatatttttccctttaagcataaatctgtgattgggagattgatttctgagtaactctttggtaacccatttaaattgtcatcttccaattttctgtattttggcataaactgaataactaaaatataacttaataccagcatgatagatttgtttttcttctgttagatactttagaattcatctagacttctcacagacctcgataaataactcagcagtcagaatggaaaacaaatttatatagtggaaatctcattaatgggaatgaacaatacaactgtattcaaggtttaggcaggagaaggaaaatgatagaaatgtatttgtttaattttaaagattcttatgataaaatgatcattaattagggaagataagtagaaaaagacagtcctttctgggacatttgaagactaacagccttttattgaaagtcctggaaaagtatgtgtaaaaagccagccatgatgatcttttacctacacttccttaggagactttccctcagcaagatgtgtctttctaaaaacaaaagataagagacaataggagcccacataggatggaaagctagaaatcaggtgggttaaaaataatttcatctacactatcttccccttctcaaaagatttttaatctgtaaatggcaacttatacatggaaggattataaaatacataaaattactttttatttgtcttctcagatatatggcgtgttctttatcttccccttgttccaagtaattttgttaagcagtaaacaacgtggaagacaggttggtcaggagataagcagttgattccgtgttttttgaagagaacttttatgatagtaggaagaggagggcagtgctggtcctgtagtgcagtcgtgtagtactgtttgctgtgggacaagaggaaggaacagactggcaggaagggactgcagcatggaagggtgctaagtgcgtcactgagtgataagggtgctaagtgcaggaaggcccactggatgggcagggtgagagtgggttcaggttgtaggtgtggagttggacaggctggccttgttctagcagcaccatttactagctgtgccaccctaggcaagtcaccttctctgctcctcatttcccttctctctaaatggtgataataagagaagctaccctctgaagttgttaggattaactgagctgatacatagatgtaaaacccataggacagtacctagcacgttgcatccaacaagtgtcagcaaaatattagcctagccagtcacctgtggccattatcaacatctgtctccagttagtcaccacctttggtcaattctgcatttgaatatttcttaaagatgatttatcttctctgccctcatggccatagccttagtgtacagactttttaactctcaaataaattaattccgtttattcttttagtcaaattttactaaaatccattgtgcagaaaatgacctgttaattttctaaaatgcagatcttgccctgccactctgcttaaatccctgtcatggttttctgtcatccttaaggaatttataattaactttcagcattaaaggcatgcagagttcttcaaaagttagctcttgcttgccttccaacctcatctctcatcagatactttatgaacatcatatattctaattcttactatacctttccaaaaggcagtcctcattttgcacagtgatgcaggactgtaacagtgatggttcaagctgaactacacacaacaatcttaataacagtgggagcaactccagtattcccatgacctttgaatgtttttgttaaaacattaaaaattctctgtcagtgataaatatgtatggaaatgaaaaagtaaaactggtattgatgtagtatactgtaatgtaaaacattagatgaaaggctcacacctgtaatcccacactttgggaggccgagacagacggattgcctgaggtcaggagttcgagaccagcctggccaacatgatgaaaccctgtctgtactaaaaatgcaaaaattggctgggtgtggtggcgggcacctgtaaatccagctacttgggaggctggagcaggagaatcacttgaacctgggagagggaggttgcagtgagctgagattgtgccattggactgcagcctgggtgagaagagcgaagctccatctcccaaaaaaaaaaaaaaaaaaatcagaagaattgagaattaaaaacttatcaggagtagtttgaacagtgcttgtcttcttcatcttgtcatacgatataagatgggcctagcatcttttctatgacttggtgaatttccatactcctttctaagtttggatcagtttcccgtatttcatcctttgtgctttcagtgagtttcattaatgtgaagtttttttgctggcatcacttcctctgggacgtctttattcttttgctaatttatgtgaagctgccttcaccaagctcctgtggctgcacatcattgtctcttagatgtcgttagtgtctcttagatgtcgttagtgtctcttagatgtcgttagtgtctcttagatgtcgttagtgtctcttagatgtcattcccatagtcagctatttcttctctaaacgtcgtttatgtttgattcagatttcactttgagtttaccagtgtttcagtgctgtactttcatctttgctgcccaattccctctttggattacccatttttgtaaaatgtcaagtgggttaatcactgtgagacatggtggcagcacaactatatgcttttctgtctgtgtaccaactcagatgcacagtgaccaatcactgacaggctttgaaagaagtgacgtgattggtcatggatcatgatacagatctgttatttactcagtgattggtgcactgaatagctagtggtgaagtttcttttatgtaattattattgattaatttatcatagtaactgacatttgagtcttattattggcagaatgatgttaattaaactgtggtaactgaaatttatgcatctcagaactgtgcaaagcaaggactgcgagtatgttataaccatttcacaaagtcttaaaggttaaatggctacatacagcacatggccaaaaagtggcagaattacattaacataacttttcaaatatctttgatatttatgttataaggaggcacaatctgtctcttaatgcttctgtcaaattaaatactcatggagttcaaatacaaatggattgtcttcagaaaaaaattattagcatgtgtatttaggtccatagccctataggaactctgtctgtgcttagcttgggctaaccatgtaagactgccaagatttgcataaaaatccaattattgtaaagagctactcaaagctagcaacatacctgaccttatctgaggttattttttggaatgaatcaagagtccccagccttggagtgatgaaaagaccatcatttttatttgttttattctggaacaaataaaaaatccctggaaaggaaaggaacatcccgtagtcaagtggagaaaactggtctaaatagttagcagtggagatattgagatactctgcttaggatgagagatcagcagcagtgggtagggatgttaatgactggaccttaagcttcagggattcagaaataagttcagttagttctcttaggaataagttaaatagtgtctgctcaattcatctggccggctggtagtcagagtccacagtaagtagtcaaatttgaaagttgtaagatacaatccagcttctgcaataatgagaaggctcagtttggagcatctaaaattgttcagggtacaagagaactgagatacacagatggactaaaataatactcagttgtggatagatgaaggctgagaaaaaatatgataaaaggctttttttaagtgcctctaaaatgccaggtcttctagattacttttacttatttgtaatgtaattcttataaacatcttgttagcaggtgttatagttgttatttagaacttttctgagattatagagctagtaagtaatagagttgggttttttgttgtttttaatccaggcccttttaaatatataactcctaaatgaaagataccagacccaaacattatgaaaagaaggatatttggggagtgcatctctcatttttgatcttgcatgttgtgttgtatggaccttggaatgtaattttctgtagaaatatttgaaaatgtaatttgatacccagtccacactgcaaaagcctatttttttttttttttgtcagggtcttgctctatcacccaggctgtagtgcagtggcacaatctcagtttactgcagcttcagcctcctgggctcaagcaatcctcccgcctcagcctcctgagtagctgggattacaggtgtgggacaccatgtctggctttttttttttttgtagagacaggtctcactatgttgcccaggctggtgttaagccctgggttcaagcagtcctcctgctttggcctcccaatgagttgggattacaggcatgagccaccatgacagatatagagacacatatggagacacatagagatgtgcatgtaaaataggcccaaaagcctatccgtatgtgtctctctatctgtatatacatttctttctgtgctatttaaaatacatgcagtcactgtgtgacatattacatttcaagtgccaacttgggaatggtggaactctgcctctcaccttgaggacagcccttctttgcagcacagtcaatgactaggaggacagtaggcctgtgtttacatctgtgcaagaatggcatctgccttcatctccgcatgctcctagagaaggagccgtttcagcgagtcacttctcaggtattctaaatttggtaataaaaggacttgatgcactccaggtgcagtttctctgaccatatcaatgttcttaatttttttttgaggggaggggactgtgtcctaattagtaattaaggttattttgatagcaagtgttagaaaaatgctaattccaagactacaagcgtatttcacattctgaaatccaggtatcctaagggaccatggactggaactccactagatactactcagaagcttcgtccgcctcatctgtctctacttttacctctgtgacctagaggtcacttgaaacaagcttcctcctgctcgtcagcttcattcctctctttctgatgactgtctttctctagccatctgagcctcctgtcctatgtgacagtctcagctcatgactttccatcccctcagtttcaagagtgtgtctgagacctgattccagaatcccaaaaggcagaatgacattgactgacccaactggagttcgttaggtatccgtggcttgttaggaatctatctctagtaggaatgtctgctgccctgggggccgaatcctgcctgtgcatgacctgctagggcccatgcctccggtggatggaatgaagcaaggatgggggctgcctgcagagctgtgtcactcacttgtattcagctttcctgcctctggctctctgtcttttacctttttttgttcgtttgtgttttgagatggaatctcgctctgttgctcaggatggagtgcagtggctagatcttggcttactgcaacctccgcctctcgggttcaagtgattcttctgcctcagcctcctgaatagctgagactacaggcacatgctgccacgcctggctaatttttttatttttcatagagacagggtttcaccatgttggccaggttggtctcaaactcctgagctcaagtgatccgcttgcctcagcgtcccaaagtgctgggattacaggcgtgaggcaccacgcctggccttttatcacttttaaactaagaaaacaatgatcaccatacatgctctgcttccaaactatactttcacatccaaagtacccccagatcataaagtgccaccaaagagctgtgatatgaagaaagaccccgggtagaatcactctgaaaatgtgggaggtttttttttttttttttttttttaaagcaaattcattttacttagccagaatcctaatagcctgctgatttttgtagatgattactctgaaaacatatgcattggtgtggtctatgagtaaggctctgccttttaagtcacattctttgctgcttcattgcaatgaaaaataccaaaggtgaataccaaatcaattttttttagtattgtacttgtaaagacagtccatgaagtggtgagtgggagaatcaaacttttgtggtaatcttttattgtaatctactttcagctcagagaagcagcatagcctggtggactaagggaggatggggagtttggagctctgagatatgaactgttttgcaatgactagttttgtgaccttgagaaaggaccttaacctctgtctatgtcttcatatgtaaaatgggatctacctgatagaaacataggtgcattcatatgtgagcaaactgaataattagatctcacataaatcaggagtgattttttttttaaatggctgaagcctgcggtttataaaaagattctccctagaattcctttaagacctaaccttttctcaggggtgtttaaactgtgattaacaaatgttaaattatacatcccagtttacaaaatatacccgttgaatagagtgagactaacatgactttttgtctcataaaattatgacaataactcagtcagtctgtgtgaaatactttgtaaacagagctttgcaggctgcagtaaaaaaaaaaaaatatatatatgtattttatatttaaaaaatatatatttttatatatatatatatccccatacctgaagattttggggtgaactttttccaggttaagaatgacattagtgccaactgtgctgtattttggctatcgtgatgacattagtatcatcaaattggtcgtggcattgggacactggcagcatgtcatcctgccccagtcaagaatgactgtaggcagtttcagtttatctgttgctactagaattttgatgtagcagtgtcaaaaggttgatttgtactatggcaatcttattcctagatgtgaattctccagggggcaaaatatcctaaaagctaacatgtaaacaagctcaaaggattaatgtagtaggaagaaatagtagtttgttatatattcatgttgaatttaggtaactattttagttatttaaaagattactaccgaagggaagaaacatattttgctaggtttcgcatagaaaaacctgtgtctggctcaaggtaatacttgaattttaataggaacctaggtttgctgtcttcccagtgtagactgtagcctgcactgtcatagaagagtgttgattgatccggttgtgaaatagatggatacccacatttaagttgcttttgaaagagtcagtttccctccacaaatatggcaacaaaattcttttataatccacaaatagaatttttcttcatctgaaagagatttctcctaaaccagcctgaaaaattgcttttctaggaagaatttcatggctgagcctcattcttgtacagattcatagcatgttattactaacttgtaaatattcacttacagaagagagtgactagaatctttgaattcttttatattggtgttgaggtttctatccaagttacgcagtttttcattcattttagaggaagattttctcaaacaaggattcttcgtggttgcaaaacctatccccagagattccagtcaacataattcaagttgaccagtggattctaagtgtgacagtacggtgtttagcaagtccaagtgaaaccagatggaggtcagagaatatgcctggcttcgtccacattatctagttatctgcctcaaccctctagtttcaaccagcttcaagtgaatgttaaaccagactgctgtaatctacacatgctttcacacttcaaaaggtgtgtgttagttgatatttggtttagtcatttcgtctcttgagaggaggggttgaagtttttatttccagtagtattttattttattttattggatgaagttgtttttatttcttttctccagaagaggtaaggaaggttcctggattattgtatttggttggtaaactctcctctttttctctttctgtgtctgcatctcctcctttttctctttccctatttcttcttcctcttccttaggtttatatgaaatagaaacaattttctagcacaatgactaagtgaattgctacattaaagactggctggccaagaaatggttaatctttgtatggcaggctttagggaccaacatcaaatacaaacatgttggaaatctttttgtcattccagctcaattgattcagaaaaattttaagagcaatagtcagtgcttggaggaaaaaagaatactattgtaaatttgagacgttctcatcttgaacatggctcttgtaaatcacaagcttgacaaccttacagagtacatacaagccgtggttgacttcagaaatatgtgttttagacacagttttacatgaaagtcatgatattgtaaatataatgatttattaataagtttaacttttgttaggatactttgcgcataactaccgcaatgcattaagaaggaagtgttaagaattttcatcccacagatctgatgatttaaagtagtgttccatttgtgcagtcaatagaaggaggtgcaacaatgaaacagaaacaaggcaaaatctatccatatgggctcatcttatgacctgttcttgctggtaattttggcgtattttgtgatgatttttttttcctctctttttgaaggctcagtagctgtactactcactctaccaggccaaagagtcagcgtgatggagagaagattaggaaatcatgttttaaaattcttctaatgcagatgaatatgtcaacatgatttttctttcatcaggagcctgtaagagaatttccaccttgttcgccttggttttggtatatgaggtggactttttacttaggtgtcctccctgttgttttgaggctatgtgccctacgccactgtggtttaccctgaggaagtttgcgtagctcgcgtgccaaccacttctcttggagaagacggagtgtcataactacagctaacatttattaaggatcttgcatgtttttcattttaatcctcacagctccttaagtattatctccattttgtagatgggacatctctggctcaggctcaaagatgttaagtagctcacctaaggtcattttgccagctaagtaaccaagctggggtttcagcccaagccaactttaccgagtgtggatggttttaaccagttctctcgatttgcctccctgtgaggtgtgagttgttgccatcattaacccaggcctatctgcttttggggttcagagttggaaccatctgcagggagtgtagatagaatcatggggggggacagagcacaccctagtggagcctgccaagactcctcattgagcccagaaaactgagatacaggttagaattggccatttcatcgcagtgtttatttcatgttttctcatctcacaggtgagttttctagaggaaagatgatgaagtaaaattttacaacaatttttgaatacttttcctaactgtcaaatctccgtctggatcccattaataagatacaaagttatatcccaaaagtaccaaattatgtaattctttttctgattagttcattgcaacttgttcagcttcaaataaattaaagatttcttagttattgtgattcttaataattttgcaaaagtctctgtatttttttttttgaaatctttttctcattatttatggaagatagtgattgggagaaagcaaaatattaggcattaaaacagattatactggagagatctattccagtgtgatcaccaaatccacctattttgatacttgacttatgaaggggactgcctttttttttttttttttttttttttttgagacggagtcttgctttgttgcccaggctggagtgcagtgacttgatctcagctcactgcaacctctgcctcccgggttcaagcaattatcctgcctcaggctcctgagtagctgggactacaggcacagacagtcacgcccagctaattattatgattatgattatgattattattattattattttgtattttagtagagacggggtttcaccgtgttgtccaggctggtttcgaactcctgagctcaggcaatccgcccgcttcggcctcccaaagtgctgggattacaggagtgagccactgcactctgtgggggcttttaaagaggaagtgaagggtaactcatctctatcctactttacatgccccacctaagtccaactcccactgcctgtcttctaagggacatcttgtggcttgttctctgctctgctcgtattcagtctctacgtccctcatgctttctcatggatttacaatgattacttactctcaaacttatatttccagccctaacctctccagtgatcatttgttaacaagattgtgttaaaggaagcaacaaaggttcttctattggatgtagttgaaaaagcagaactgttgctctggcctaaacattaactttggagaggtttaaattctgtttagaagttataaatgagcttaatatcatgtgatttgcatgataagttattttaaagagtttaaatccatgattgttcaaaataggttgttttattttcaatataatatggttcttaattgtaacattaatgaacactgaagacatttttaagattcatttatgtaaagtgatttgatgaagtaagctgacatttgatggacttagtggaagtttagacccaatttgcatttcagtggtattttatggctgactttagaaaactttttagataggatttctcggtaaattaaaggatttagagggatgattacgaaataattgattaaaaagtgtgcaatattggttttcattgaacttaagcttgtatgggttcaatttaaaacctaattcaatacattttagattttatatttccctgaacctcttctgctgtattaattttgtcatgcttgtcattctaatctaatgatgatttaatgtttgcaaacctgaataaatctgtatgcaaggagttttgctgtgtttttaatcaatgaagattgaaatttggcaactgaggtgataaaaaatgaaaaattttaaatagaaaatgaaaataatgattatactttagaaagtactcttattaatgttcttggctatgaaccatgtaatatttttctcttatttttatcgtgtaatattttgaaggtgactgaaccttaaaagaagtaattgccactaaatcgtgaagaatgtttaaattagaacagattctttgtcctcactgtcttcccctttccctgaaatctgtagtctagagttgtgaataagagccagaagaatgttaaactgccttttaaaaactcgtctaccctccccaagaacctacatagacaatagaatgttctgtaatgaaagtgtatctttacctcattatttatttattttattgagcaaaaaatgtagaacatagaatgtctaacggattagtcacaataaaaaaaatttcctgggttatatatgtaaggggcagcggctgctcctctatcagtccaggagagcctggtctgatttcacattgcttttctttccacatgatctcatgacactaaaagacgattaatacatcctttaaaaatcaatacgggacattttactgtagtccttcacctttattgttcagtacccttcaggggtgaaaggagatattccaatgcaaaaaatatgtctgaaaacctgagtggtaagtaataaaagtttttttttctcttaaaaagtcttataacattgttatttcccagatttgaggggtgggccttggggtggaattaaaaaatcagtgtaatcatttgtaaggacaaaatgcgagtttctataaagaatgttttagcataatgtcactaatgttttgcagtgtgtagagagcaaactttaaaaaaagatgtgaaaatttacaaaccagtaatcctctatttcatgtgccagcagtcaaaattacgtgtgatcggctgggtgcagtggctcacacttgtaatctcagagctttgggaagctgaggtgggaagattgcttgaggtcaggagtttgagatcagcctgggcaacagcaagaccccttctctacaaaaaataaagttagctggatgtgatggtgcgcgcctgtagtcccacctatttcagggggcagggctaggagtttcaggtttcagtgagctgtgatcgtgccactgcactccagcctgggtgacagagtcggatcctgtctctgccaaaaaattaataatactaaaaaaattagatatgattaaggataccaaaaaattattcagataccttagtggaagctttggctgaatagaagttccatcttttgtagtactgaaaccaagtgaagggattacgtagttgacatctctgaaagagagaacgcagtggtaatgagaatactccccctacgtttgtgtatgagccttggcagtttcttttacactctctcatttaatcctctaagacctgagacattgttggggcaagtggaattattctgcattttatagatgaagaaatggacttggaataattaagttatttacagctaacccgcaccccagatctcttgacctagccccctgcatcctgcctttgccccagagtgcttttaatgttctgcattgcatggtctttttgttcattttattttatgtatcatagttaatactaaactgaacgtttgctgctaagacctatattattttatattcccaatgaatatgacttctgcataaaaacatttaactagggtaatcattttatagtatgtgcctgttgtctctgctatatctatcaccttcatgtgaagacagagaaaatagaatatgctgtgtattcgaaataatttcttctttacaatgatgtattctagattctaacatttacatatgagagaagcttcataaatgttacgttttctgtggccgctatttctgtcttatctgtgctgtctacacagtgaggacagctgcagagacactgccagtctcatgaagtgtccattgtgaaggcccatgtgtcagtgctgctgatggcatgcaggagttggtcagtaggatggttaagaacatgggctctggagtggacggtgtctggcttcaatctggggctgtcacttagttggtgtgggacctctcatctctattgccaacccaagtttttgattctttctttcctcagtaaactcttaatctttctgtccttggaatcttctcctttcacttcaaacaactcatctgtctttatcctgaaaagtttatactttactaagttccatcattggcagcaaccctgttttcttcccctttgtattaatattttttttttttttttttttgagatggagtttcactcttgttgcccaggctggagtgcagtggtgcgatcttggctcactgcaacctctgcctcctgggttgaagtgattctcctgcctcagcctcccgagtagttgggattactgttgcctgctaccacgcccagctcacttttgtatttttagtagagatggggttttaccacgttggccaggctggtctcaaactcctgacctctcgtgatcagcctgcctcagcctcccaaagtgctgggattacaggtgtgaatcaccatgcccggcccccctttctattaattatccaacatctcaaatgtgcagttcatcacatttttggggtggtggttagacacaatatagttaacctatttagataaataaactcttttatttcccctgagtgaacatttcatctaaaacgtgtgtcgctttcttgcttaaaaaccaataaagctaatgtttctcaagtcatcatatatgagtagcatgcaagctccggatgcagctgttcctctagagactactgttgcgctccttacaagcctctagagcactagtgaagagtaatgttagattgtttcgggtttggtcaacctttcctaagactcagtggacagcaatcagttaatgtgccaagaagcataagctaaatccagattgcaacatactactcattctgaatctgtaagggaatgcctctgtgagtcactgttgtgggaatgtcctgggatggcatagttaatactttctaatgggatttaaaaagtcagtacatttctctttttgaatttgtttcttaatgatctgatgcacttttggataagatacagcttgctttatagaacagaaaaaacattgtcatttatacatgatttagctttatgatcatgatttaaagccaccagctttgtgggaggaagatagtgagaatggccatgacagctttaactacacccttgaagacctccttgcttactagagggcactgtgctgtcctcagatgccctgaggcaggtcagattgggataataattacattaactcccaaactaccctgtgctggactttttttttaagttatagctctatggagatataattgaaatatagtaaatgggaaatatttaagatatataatttgatatgctttgacatattcacagtagtcccctctcacctgcatattcatttttttgtagtttcagtcacctgtggtccgaaaacattaaatggaaatccggaagtaaataattcatcagttttaaattgtgcaccgtcctgagtagtgtgatggaatctcgcaccatcccttgtgccctgtaaaatgaaggtgtattccagagaacaaaggaaggatggagcttttatagagcatctttctgcccaggtttgcattcaggtatattttttcaaatgaaggagtccaccttgcttagttcaggttgctcagtgcaagtgatttctgattggttggtgcaggctatacagtctgttggttcaggtggcctgaacaggaatggtaagctgcgaaggttcggagttaaacagatgtgtaggttttctggaaacttggggtacatgtgtgaccattagactcagttagcccctcaggattcatcttgagggatttgctctttgaggttcacagtgatcagatcaactgttgcagtatctcagtgcttgtgttcaagtaacccttattttaattaataatgaccacaaagtataggagtagtgttgttggcaattaggatgtgccagagagaagatagaaagtgcttcctttaaatgaaaaggtgaacgttcttgacttaagaaggaaagagaaaaatatgctgaggttgctaagattaagaacaaatctatccatgaaattgtgaaacaggacaagtaaatttatgctggtcttgctgttgcacctcaaactgcaaaagttatggccacaatgtgtattaagtgcttagttaaggtggaaaggtaaatttgtgagtggaagatacgaaccaaaaagatgttccaattgacagcaatgtgttgtgccagaatcattcagcctatatgacgacttgagcaagggatcccttgaaatgagttacaccaagtgagggatagttacacagattcaagaatacagataatcagtagtagcctaatgctgcgtcacaatgcatacgtctttcaccctacttcatctcattacataggcattgtaccatgtcacatcattacaagaagaaaggtgagtatagtacagtgaaatattttgagacagcccatgttcacataactattattacagtatgttataattctattttattactagttattgttaatattttattttatgatttataaattaaactgtatcataggtaaatatgaataggaaaaaacagtatatatagggttcagtactatctggtttcaggcattgactggggcctttgaatgtatctcttgcagataaggaggactcttgtacatcatgacatgtgtggatccaaaatctcaaaaaaacaaaaaacaaacaaaaaaaaaccaaaatctctttttgtgtgtgtacatgaattgttccagcaccatttgttgaaaaggcttcccttccttcactgaattgcctattcactttcttggaaatcacttgtccatgtatgtgtggatctatttttggactctgttttgttccgttgatacatttgtgtctctttgcaaccactctattttgattgctgtcacttcatcataattcctgaagtcaggtatcattagcctcccaactttgttttcctttttagaaacagcttgttagtttctaccaaaagatatcctgagattttgactgggattgcattggatcttgtaaatcaatttgggtagaatagacatcttaacaacatcgagtcatttctgagtctctcacatgtaaaaccattatctgcgtttaaaatgtaaaccactcagtgtcaccgatcataaaccaaaagtgatacttagggtaccttgaaattacattaagcagaacactgggaattggtctttttgcttgatttgcctgagtgattctccacaaaatccccacttaatatgataggtatgaatacgggatgccttatccagagcagctctccacaagcatcctcacgccacagatgccagttgaccgttacgtgtactcacctagcctgctggtacctgccagatggtgggcattttgggtgagattatgatagatttaagccagaggttcaggaatatccacattctccaaaaaagaagattaagccattattattgggagcagcctaattctagttatgaaggaaagagatcagggtgccatatgtacttagatagccatgtcttttatagcacatagcctttcatgttaaagctccgcatttttctaaaggagtattgattatagtaaggaagccaaggttcaactcgtgtatgtgtcaggtagctggatcattcattaccaccataggtgacacccatgttgatcagttacataaagaccacaaatggaatggtaactgggtcattgcaaattaaccctttctgaaagacagttcaggacatatttatccttgagagtgagcctacactatcctcctaagacctctcttttaagtggagaatatacattttggaaacaaggttgtattgtggttgagggcatgaagtcaacctgcctgagttcaaatcaccactctgcccttttctaacttttcaaatttagggattcacttagtttctctaagcctattttctttgagaatatggaaaattattatagtaacatggggaaattaaaagtgagtaattgtacaagtttagtgcacttgatatgttttgtttttagcatattttctccatttttcctttttccttttgtgtgttcttgttgccagtgactacctgtgaaatgtaaactgttgagtgaactgcttttgctttactttctgtgaattacttgttctactcactgtgttctgtctcttccattccctccgaacacttttgatcttttcgttttgccccagtcttctttcatttaaaaactaatttctcccaagaagcctgctctataaaggatgtgtagattagatgaggtgtgggaagcatgtttacttataaagcaacacaataccctatccatatccagcctgtaaaaataaaaatctaagtgctttttttttttttccctcccaagtaaagagaaaagtttcagggttatatccttaacatgtaattaagagagttcaagatattttatgttctatatagcaatgcagagaatatttaataagcattaacaaaaaaacttaaccttgtggtagatagcattgtactaattaacagtttattttatttagctacaagaactatgtcagcatgagagctaacactacttatgtttgacaattttagaataggaataaggtaaaaatactcaacagagataatggtagcttgcaaaccgtttatgtcaaatatattaaaatttggaatagttgaagactagaatccaaattcaagagtaattaaccaaaatagttgacagatgtcagccatgctaataaaatttgtataccctgaatattttccagcttgtaattaactgcacagatgatgtgatctgattttgtcactaactgcttattaatgaaggagatgatgactagttacaaaatccatagtgctagctgaattccaagtttaaatgtttctcatacagccggcattaattggagccacactagcctccatgctggtttgatttgtgcttactttcttcatttgtaattgcgaaggggaaactgaatttgttaaattcagctctgagtgaccttgaagatagtaaatctgtttttatttggtggtcagcagcgtaatggcttttatttttagattctttcttataaatgtattgtcatcaggctagtgatatcaccattggaagttgtataataaagtgcaaactgattatttcaagttcagctaaaccacagcagaacatgatgtcaatatgactgaagatgtgaacacagagtgctattaacaaatggtttaataacaaaagagcattatttatttctatcatatacatagcacggaagcctgagaagaagcaaaaggattcaagagaggcggttgtgcagccttcctgcctgcgccagctctctcccagactcctatactgctcttccttctttaccttacgttgctgtttccctttttacttctttccctggaaagggcgggtttaattctgtccttatttataagacagagatgtttgctacctcctgagcccaagtctgccagctgttggccttcttctttgggtggtctccctggcagtgtggtcttacagtatttatgtctgcctgctagctggttttgcctgttggacatctccacttggatgtctaccagacatccccaacttccatgttcttagtgtcactttaattttcctttccccaaattattttctctaccgtagtctcttctttcttatttttgtatttctgtgtttaggagtgcttaatgaatatttattgagtcaatgggtgatttcatgatacaattatagtagcaggtagtactaaaaagaggaactattttctccttatttaagaactttttataagagaactctagtttttcaaaattctgtttaaaatgggccacccagaactggacacactcttctgttgttcgttagtgttcgccttagatggccccacctctctgtcccctctctctagctatgtatatttcttttcaacagtcagttgttagattgctgtccttgattggttttctgttttcagtaggccagtccccagctaaattgggtgaccaacttggctaatgtccagttttatctaaagtgatgttccctgtttgcacagatgactttttaaaatctcctgcaaatgtgatcccctttagagccctacctgcatggtttgaatagcctcagtagccaatttcacaaacaaaaatgtaaggtctatgtgatgtagagtaataagataagaaactatttcctacttacaaactactttgaaaaattttgaaagatgagtttaaaatgtttaaaacattggtaataccagcagagtcagtaggcatatttgtaggatacttagtataaattttggtgtatttattttcttaaaataaatcacagtgaaatcatattattgtatcttataaaatgccttactctgttgaaaaggcagatttatattaaaaacctactagctgcatttatattaaaattgttcaccttattaacaggtcaaacaatatattcttttaagaattcacattttaacacttgggtttcagctgataaaacttatatgcatttgggtataatcttagatacctacaaaacagcaccaagacaaaaatgggctcaataataatgagagagcaagtattttaaagaaaacagaatttactgacttttaccatggttaggttaagttaggttaaactgtggaaggaaattgtgctgtctctcccctaaaaagtttaagagcaaattatcatcttgaatggtttagttattcacatgactgaagttaggaaccattccttttaactttttattttgaaataattatagatgtgtaaggacttgcaaagatagtacagagagctctttgtgctcctcacctggttgctcctaatggatattgcttatataatttagtacacatcaaaatcagaaaactgacattggtacaatgtatatgtgtggttctatgtcattttatgaaccttccttgaactcttcttaccccacactgtttataactgtcttacatatttcttctacacacattaagaatcacattagacaatattatttttgtttcagccatcaaacataatttagaaaactcaagagaagacagtctattgtgtttacccatatttttgcttatgttttttcttccttcctttccttcctgatgttctaatattctcttatcacttttgtttttttcaactttctttacatattcttgagggtcggtctactggagacaaattctctttattatttcaactgagaatgtcttaatttttatcttcatttgccaaggataattttgctggatatagaatttgcagttgacagctcttttctttcagcccttgaaaaatgttctattgctcccttctggtcctctttagtttctaatgagaaattctgtcatttgagttggtttccctgttaggtaagatctcatttctttctcaagacatgctaataatcataagattggttattgtaattcaagcagctactatgtgcttggcatggtgtatgctgtctgtaaccttgaaaccctctattatctctattttgtggataaagaatctgaaactcatgcaagtacattaacttagctaaggtcacacaatttagaaatgtttgagttaaggtatgaaccaaggcttgtgtgcatctaaaatttttgcactttatcatacaattgcggaaagttggagacaatcttatagttgataagttttctaccagcatcttacagcaaaaattacaatttttctgccagtcctttctttgactttgagtagaatcttaaaaagacactgtgtaagagccacgaaacttccttgcagaagctgtatcatgctaaatgttttggatcaattcaactcaatttaataagtctctgcttttaatttcattttctcaccgtgcattataaaatagcatttgtagaataagttaataataattttaagcaatacctattttcaaacaagacaaaattattattctatttgaattcaatccctaacaaataactagtatcaaatcagtggtactgcaaagaatagttaatatccagggtattgttttagctgcaagtgtttgtggattactgaacagtcaagtgggtttgctttgagattattgctttcccatgtgtttattctcttcacagtctttttcagttgttgcctggttcatctttttagacatcatgtaattggtagaacaacagtcaagaaaaaggttgaaaaaaaatacagatgagttctctggagatacgatgaagcaatctgagtgaatcatgatgtgcagtgggctttaggtttctatttttgtgcaagggaccgattatagagctctgaacttgaaatcttattaaaatctctgaagatgcagtagaatacatctcatttaagaagtgttctctaagagatttataattcagtattgtttatatatgtcttagtatattagatattattcattaacctatattagaggagacaatattttacttaatattttcttaagttacaaaagtaaaataacttaatagtaacaattggaatgattaacatattgtgaagcgaaacttatctttaccctagctgattgtgtaccatctcttctcaaataatgtgatattaatctccaactgatgttaacattgtagggtgtatctcttcatactcttccccatgctcaaacaagtacacacacacactcacttactcttcacatgtgttggacttcaataataataaatgtatgcttcataaattggaccattcgctaagttgccccccaccccattcttctaggacagtatgtatagaacagaatcacttaaaattaactggagtgtattctatagtatgaatgtactaattaattcagttattgcatattgatgtacatttgggtggcttcctgtgaggtattgttttttgtttctgttataaacaatgagacggtaaatatcttagcttatatatcttttttttttttttttttttttgagatagagtttcactctcgttgcccaggctggagtgcaatggcatgatctcggctcaccgcaacctctgcctcccgggttcaagtgattctcctgcctcagcctctcgagtagctgggattataagcatgcgccaccatgcctggctaatttcgtatttttagtagagacagggtttctccatgttagtcaggctggtctcgaattcccgagctcaggtgatccacccacctcagcctcccacagtgctgggattgcaggtgtgagccactgcacccggcctatatatctttattcttacacaacaatgctttgatttccagagggtaggtttctgataatgggactgacagttcaagggatatgtatacttaacattgtatagatattagtagatttctttcctaaatgtttactgcagtcttgtataaggttcattttatcacatctttaacagcactaggtgttatcactctttaagcaaatgtgatcggtgaaaactgctatctcgttgctttaagttgcatttgctgaatattggtgaagttgaacggcttatgtttattggccatttcagttttgtcttgtgtgaatttctgctcatattatctggccatttttctattgagttgccttttacttaccagtttctgggagtagtttttatattagggatattaactgtttggttatttattttggaagttttcccagtctatgtatttttgaagtggtttagggtatttttttttgctctagaataaattaaaatatatgtaatcacattgatctatctttgtttaggttttccatcttagttctacaaatatttgcctaaattctcttatgaatgttactgtcttattttttatataaatatcttttaattcatctggattttacttctatatatggtgagatatgtgagtcaagctttgcatttttgtagatatctagccacttattatgctaatgccatttagtaaataaaccaccctttctttctgaatttaaatgccatcagtactttaaaaaaatatttaaatggttacatttttccccagcttaacccattttcagtaaggtaatgactttttaaaagcaggatttagtaagttgaaaaggttatttctctttgctcaaatgtcaaatgctacctgttactctttattgtttctggctaaaattgcgagcacaggaaggattattcctgcgaacaaattcactaatcagcttgcaacctaacaattttaagaccctggggaaaaaagggaaagtttgggatatttactcatttcttctgtaaaagcaataacatgtaaacatagtgaagaaaggcatttatggaatctaagaaggaaagctctttgcttttcacatacagagaaattaggattcattgagtcctttctttacaacataagctctgtaggaatggttctccaagtaaagctgtgtgtcacgttttggggctaggggtgcctcaaagctgcacctacagagagatctgaaggcaaattgccgatttcacacttttattttgggctcatcctttatgccctgcacagagcgatcagatccatacacatcttactttcattcattgtggaaataatgtcctcaggcttggtggtacaaaatcgtgctttctacagtcttctgctaggaaatgtttattggatttagctgccattatacaaatgatgaaggagaggcaaagtaactccagtatctctagccaggagtggcttgaagaattgtatcagttacagatttgagaagatttgactatatgttgaattaggttagatcatctttataattagaagtaggcttttggagtacaaagaattcttctgtaaacaccttgaatatttaacaggaaggccataaggaaatataatgtgctacattcctaggatagaataacatgcagctattaaatagcacattttgtgaatatttaatagtagcatttaaacccaaaagacactgagcggcagagacctgtgtaactagtttgttcgttcatttcttcattcagccaatatttactgaacatcagctgtgctttcagcattttgtgaggctctggggaataaagatgaagggtgtagtctttgccctcctatagcttaggagctagtggacactcaggttacatcattgcagaactgtttattaacaattagccacgtgtccaggatgccatgaaaacgtagaggggaacacacaaatcagactggctgttggggggtcgacgagacttcatggaagtggtcacatcggagctgcgctccagaggaagaaaggaattaaccaggcataaaggttgagggtggttggagggagaggagctttcaactaggggtgaatagtaaatatagacactgaagaaaaatggaaatgtgtgtggtaaagtccgttattctgtataattggatcatatgtatgtgcacatgtgttcatatttatcgatatgtgagagatgatgtatagagtttggtaatagtgaggaagacctcttaccccaaactaaggtgactggttttgtcttgaaagtgggttatagtaagtaggggagtggtctcttcactgctgtttagaaggacttctctggacaaatgtgtggatgaggtattattaagcccaggatcttgaagatgagtagaatggtagcataataatctgggtgagaaatgtttggggcagataataaagtgggatgtttgagagagattttaagaagtagcagtgctagcatttgggatataaaggaagggaaggggtctaggatgatacgtagatttctagtttggaacaagtagacttgcagggatttggtttatgaaaacgaggggaggaatgagtttgggaatgggaagctagtgagttctgttttagacttaaatgtttggaggcttttagggttttgtggggacaaatgaagatctttattggttggctgaatagatctgaccttagctcatgtgaaaagagttggagattttgacattatcagtgtatataggtggtattttagtcatgggagtatatgaaattgcatagatggaataattgcatgaagagagaagagggatgaagatggagacatctaagatgtaggcaaaggatcacaagaagacactgagaaggaatggcaggagacataggaagaaaataggaagagaggagttttgcggaagccaaaggaggagaaagtttcataaaggaaacgatagtcattgcagtcagatggcacagagatttcacatcagctcatcctcaaacctgtctcctgggtttggcaataaagaggtcatcagtggctcaggcaagagaatgggaggcaaagtgagaggagtttataggttggctgctaagtggatgatacagtagctgggagatgatgtagggctgagcgagggtgtgggtatgtaagatgaacaagacgtgagcaatgtcctaaatctagggatgggggagagggtgaaaatataggagaaaggggcaattgttgtgaagttccaagagacaagcccggagttccaggaaaaatagggaccgctttcccactgagtctggagagaggaaggaacgttttaggatttaaggcacaggcaagtttgaggtagggcagagtaggccagggaagaatgcgaatagctgcgtttttgtttgtgaattaaagggtacattctgaggaaatggagggaagagagagggtcaggggacttggacacggggaagggagctgccttgcactgaggcctctgcagatgatcacactgcatcaatgtgatcaaaatgacgtcagtgttatcagcagtagaatcagaaacaagtcgatttcatctaatttccattatctttcactatgtgagatatttttatcctgaggatttacatgtaacataggactgagtgatttactgaaatttaagctacagccaatatttgattaacaatacaggtatgaaattaaacagtactgtcggccaccaggggttctactctgcgtgatcactttccattttgctctccttcaaaacgtccacattttttctctcagtcataaacatttaaaaaccaactgtactgggccaatcaaactagtgtagtaagtgaaagacttagagaagtgtatgcaggtggtgttgggcaattgcaaagagactagcctccaaatgggagtgttagcatagcacgcaggcttctctccttatgagctctgactccaatattgactcttttttgtatacagaaaacataatctgttcagaactcattacagtgaaggaacttgtattttaaaaacagagatagagaactaaatttgtattgagttaaattgtataaattctttaaggatttcaagggtaagccgactcacatgattaaagtaagttatgagcatttttgtttatctgttcagtgtgtttggggcttttgtcgtgtcagctttctttaggacaggtagaattttatctaacctcttaagaacaagtggttattttctcaaggactctaggatggtgctagataccccagattcttaggtgctggctttatgtgttgcctttgctaagcacttggttgctttctgccactctttggaagcaggtgattgatactagaaactgacaggttgtgagtgatgtacccttccattaaaaacagatatactaatttgcttttcaattgtagagagcctcttactataaacatccctgtaataaaggtaaccttataattagtatgtcaaaaaagcaagaaagttatgatgaacatgcattaataacaaatcaaaacctttactaataaaatgtcacattgagaggacttaattttgtgtacactttcatactaatataaggcactcttgctaatagtgaaagatggaaatatttgccaaccagctatgttatagaagaacttcctacaatattgtcctatgtacggtgacatttagaattcaaggaaatatacatagtcattgactttgtgtggaatttccctcccctcctccaccaccctgttagaaatccccgctgttgactgtttccagaagtcttgcagggtgttgtgataagagtccaattcctcttcccattcctgcctaggtcatctctttcttccctccctccttttgttctgtgattctttgttttatttttcaccacagaacatacttcattatgctgcccctgttaaaatcagttaccctattccacctgattcatccttgagaaaactactcatggccattgtgggttttaatgccactgccatccccgtcttgccattgcctcctcagctctgtcctgctaccacgatagagtggaccctgtgtcacagcaccattggtacccatcctgccactggtgtctagaactttgagcagtttaaccccccccggttttccaactctttccctcaccaacttgtgaagcctctgaactggtatctgagcagagccagtgccttgcactgtgggagtttcctgtcctaatgcttaaacaatggctctagaacttggctgggcatgaggaacatcactggcttgtaagggatgcagagccctggtcccctgaataagttgccctggtgggccaaataatgttattcctcacatttggtatccacatcaaatccctggaacctgtgaatgtgaccatttggacaaagggtcttcgcagatgtaattaaattcaggatcttgagatgaagagattatcctggattatctggtggaccctaaatgccagtacaaatatccatatgagagagagacacagagggaggggaagaaaggagaggaggcactgtgactgcaggcagagattgcagtggcgaccacacaggaaggaatgccgacagctgcctactgtaagaggcaaggagcagatttccccttagagcctccagagggagagcagcctggaacttctgggctcaaaccatcctcttgccacagtctctccactcactggcactacaggtgcaccaccatgtctggctaattttttttttacttttcatagaaacagggtcttgctatattgcccaggctggtctcaagcgatcctcctggactcaaatgatctcctggactcaagtgatcctcctgccttggcagtattttttttaatggcactgagagacagtattatttcctcccggcacatttggattgactgttaagtaatcacattcatttcctgattttgatacaatgtacgactggttttgtaggagaaaaagaattgggaagttttaggaattagaagttatgtagatttttaaacattgagaactttgtcattttcattaaaaggctaacttttttgttataacttatttcctattcacagtacatcaccagctgcttttttacttatataaacttggacccgagatcaattggttgcctgcttactcattctataaaaatttggaggcaccatacagtaagaatacataaaaataatttacatcaaggaaaaccaggtccacaaataaaatcgatacagctagattatgaaaatcaactcactttctagagtttcatctttatcattcattttaatgttacgttttttcagttttcccatttaaaaatgaacttttattaatgcatttcgattttttcgtgttccccaagatttgtgtgtgtgtgtgtgtgtgtgtgtgtgtgtgtgtgctgtgtacatttaagtctatgcaattctgttacaggtgtgggtttgtgtttccacagtcaagatacaaaatagttgcattactgcaagagtcccttgggttgtcctttcataactatcccttcccaatctctgatcagctgcaataacacatttgttttccgtttctataatacggtatgtaaccttttgggatttgctgctttactcagcataattctcttggaaataatctgatttgttgtgtttatcaacagttaattcatttttattgctcaggagtatttcatgatatggaatataccatggtttgactcttagccctttggaggacatctaggttactttcagttgttgagctgctgtgaaaatttccatgcaggtttttgtgcagacatcactttccatttctctaggatctgtgcccaagtgtgtaattgctgggttgtatagtaattgtgttcagtattataagaaactgccaaactattttccagagtgactgtaccattttactatttcaccagtgcttgagtggtaccgtttctctgtatccttgcctgcatttggtgttatccttatttttttattttagatattctgataggtatgcagtgatatcttgtggctttaattcacatttttgtaatggctactggtgttggatatcatatgatatctgttcgtgtcatttgtccattttgtaattggatttttgttttttttttactgttgagttttaaaaatatatattctagatacttgttctttgctggatatgtgggttgcagatattttctctcagtctgtagcttgtctcttcatcatcttacgagggttttcacaaagcaaaattttaaattttgatagatctaatcaattttttctatatggatttgcttttagagtcaattctaagaactctttacctaccattagttcctgaagattttctttcctttttttttttttctaaaagttctatagttttaagcattacatataagtgactcatttcaagttcattttctataaatgtgagacttgggtggagattcatttttctttttaattgttcaatggatgcctattatgccagcactgtatgttgaaaagaccattcttgccctgaattgctttttcatccgtgtaaaaaattagctgggcatcttactgtgtgtctttctggcttctctactctgttccattgatctgtgtgactcttcctccaccgataccacacagttttgattatggagctatatggtaggccttagtattggatagagtgattcttctcactttattctctgtcaagattgttttagctattctaggttctttgccttttcatataaatttttaaatagtcttatctgtgtctgtaaaaaaactttgctgagattttgataggaattgtgttaagccaatagatcaatttggcgaggagttgacattctataaggtgacattctatgcatataagttgacattctatgcttagtcacaaattctttcagttttccttgtcttagaatgttcttatttgttgttcattcctcaagggtgatttcactgatgtagaattcatggttgacagtccttttctttcagcacttgaaaaatgtgttgaaaaccttctggtctccatggtttctgttgagaagtctgctattatttgaattgttattcctctataagtacagtgttgtttttctcactgatttcaagatctttttcttcagtttttattaatttgtcttgctatgtttttccttgagtttattttgtttgggcttcactcagcttcttgaatctgtagatttatgtcttttgctaaatttgggaaatatttagccatcatttctttaaatattctttcagccccagcaactttctcctctgcttttgaagctctactgacataaatgttggatcttttgcttttgtattacaggctctgaggttcagtcatttttctcccagtctgttttctctctgttgttgctggtcaattccattgctctatcttcaagttcactgattttatgctttgttatctgcattctcttattgagctcattcagtgagtttatctttcagttattgtatttttcagttctttaactttcatttgtttttaaaaaaataacttctagttctagatttttttgttttatttttttccgagagaatacatagttgcttgttgatgtatttttgtgatggctgctttaaaatccttgtcagataattccaacatatgtctcttcttggtgctggcatcagctgctagctttttctcactcaagttgtgattcccctaggtttggttgtgatgtgtgactttgaagtgtctcttggacattttggctgttatgttaggagactcttggtcctacttaaacctgttattttagctgacagcccccttagttaggtttagcactcaggttctggcctgcttttgtgggtggttccaatgagacctcaattttagagcgtttgtcttgctgtttgggtgtcttttgttcatctgctgccgataggactcccccgatccttgcaggtgcctctcaagggtgcacaaggtgcttccgcagtcctggctgcctgggaactttaatgggggaagggagtctggaaagaagtgcttctgaccactgttgtcagtgcggttctctgttgtccgcttttctggtgccactgtgcttacttgggtgtcgttactgggattctgtttggtccgggcaaggagtgagcctgccttagctgctgcctttggttgtttgtaggtcaggaaacacggggcctggtttgctttcttcccttaggtgaggttcataagatgccctgccattacgttgtcccttcagtcttggccttcctaaccagttagtttgcctctttccacctttcttcttgcaggaagaaaatttaacttttttttctgattcttgtgcctttcccgagccaatccccacagacactatacacaatgtcttcttatctccctttaccttcccactgtcacaacttgtggttcaatcataatgtggtgtgtacatccttatgactattaattattggtcatagctgacccatacagcatacgatgaggatagctcctctctttccaggtttctgttttgcctggttggattctatgtatttatgattagctcatctctaaactgtatgaatttcagcttaatatggccaaacttgttgactggcttattatttccttttccttttcttcctggagatcttcctctaagagctacacatcagtatgagctgattgttctctgggtcttccagacagctctcatcttggcacctcacaccaccaccttctccctgtctcctttgttgttaccctgattccttggactccatgtctctctctctttctggttttacttgtttattggagcacaccttctgggagtttcctgagaatgcatgtgtaagaagtaaatgtttagacacttttgatctttggaaatgtctatattttactctcacacttgtctaggtaaaaagttcttggttgaaaaccattttccttgagaattttatattgccctttgccttatagcctccagtgattctcttgacaatggaagtgacacttggattcttttttgtgtgtgtgtgtttttccctgttggaatactcttacttgtctttttctttgatggtttgaaattttgcattgatattcgttgatgtggcatggtggccttgatctgggtcttggtgggttatttaatctggaaactaatgtttttcttttgtgggaagatatattattttcccagaaagaagtaataaaattatttctttcccctgttgtctctcttttctctttctgaaattcatttaggatataagctctaaaagtagagggatttttgtctatcctaagtgcctagagcactgtttccatagagta

SEQ ID NO: 1102 - DNA, 8062 bp, Homo sapiens
tgtataatgtaaggactggataccattaaagttacttggatagactgagttggctcacctattttagattgatatgtctcatttattaatttcattggcttcttaccaggaatattgttgttggcaggttatatatccttttttacagatgggaacatttatgcttagaacaatttagtgtttttcttaaatatcatcccgcagctattcactgactaagtcattttttgaagccaggcctttggaattttctgctaccattatgtctgcaataccaaactatctctggtaaatgagatcagaaatagagtaaagtgtgttacttcattagaaaatattaatgaaattatagcaaatattggaaatttaattaaaataataaattataaaggataaagcagagattaaaatttgagctaaatatgtattattaatcaggttattgaatatatatttttgttattcgtgtttctgatggctcttaaatcatagaaattctaaccctgtctttttgcgagaagattaaatataaagtcacacatggctttggttttgctctggaaaacaaggacttgctaccacttttccttgttcagaagttcattattttgttgacagtgtagtttcattaatctggtatttgcagggaaataacttacagactttaaaatctgtgctaaaggtgatcaaatggacattcgaatccctcatttaagttatgtcttaatgttaaaataaaaatctactttccagaaagtaactgttaaagtattttatgcaacatttcatgtgggataccttaatggttgaataataaattttacctcataaaaatgaaattcaataatacagtagctttctcagcgcagtagcatctggtctattctcatgagagccaatattttccaactcattaggatcatgtcgttctgtatgtcgtcaacattgacttagccaagcaacctttacttacataactgccaaactattaaataggtctcttgtggagtgaagtcaaatattcctcttactttacttctgccttagaagaggggaagaaaatgtacatactgtaacatttaaacatctggtctaaaaccacatcactgtaactgaataaagttatggaggtattcttcccaggtgtgcatataaaaaggattttggagttgttgaatagttctttaatcacttaggaaaaagattgaggtatattgatatgatttttctattcctctgttttcaaactacttcccccaacaccatcatgtctgctaaatacttctaatgtgttctaagatatatatttttgagatgttataaaattttcttgccagatacaggcattggctatacatttattcttgcgtaaaaaaaaatgaattgagttagatttgtattgagaactaccaattagacctcttgatatttaaattggagtaaaaagacattaatttttgtgaatcttgtgagttttaaggtgtccctatatgcacttttaataatatgaatatttattgaatttaaagtttccattttactacagcttatgtccaggtattgagagctcatttatagaatatgtggtcattattaagaagtgagtaattaatataggtttaacccatttatgctggaggttgcaattttgtgtgtgtgtgtgaaaaatcagatcttggcaatgactttgcacagtaggatataaataactcccacaagcttagcattctaataatgcaacactaggaataaaggggttaaagacacacttagaatgttaagttatgcctgacttaattttgttcctctattctgtctcagacattttgataatgtttgtaaatttttttctgatgatacttcatggcacaggaatgggaattttaggtgtcctttagtgaaagaaaatatataaagtgtaagtgtacagagtagatttgagaaaaatgcaattctttgaattattatttaagtatattttattggatatttgaaaagtaggcaatatgaatttagtgtgatttttcagtcttacagaaagtcttttatgaacatcataaaaatgtgtcaataaattactgttgataataaaatattaatagataaatgagttagatttctgcagaaaagatactttttttgccttatgtatttttttgctgtttatttgcctatgtattctttgctcatgtttatgtcttctatttgttcacaacctaaaatgtatttcttctggttgtattcacttatcagtcattttgaaaatatgtagtttgcaatctgttcagttctgggagcagatagctaacaagaaatagacatgattttagtaatgaatgtagaatcttctgtgtcacctattacaagatcaagtatggctttaaaaatggacaagagttaattacatacagtgaagaaagggactcttatttgtgagggctgtttacaaagtaccacaaactaggtgacttaaaacagcaaatttatttgttgaagccttgggctgcttaaaatcatgttggaaggcaaagcagtagctggcgtgtcacatcgccagagttggagcaaaagagagagttgggaggaggtgtcatgcactttaaaacaacatcttctgagaactcactatcacgcagcaccaagccatgagggatccatcctcatgacccaaacacctcctaccaggccccatctccatcactggggattacatttcagcatgtgatttgaggggatgacaaatatccaacccatatcacatatcattaagacttcttttctttctttttatttcctttttttattgattctacttggaggaaaattgtaatatttcataatttaaaatgaaattttggttgcaaaattccattaatcccaagtttctgattctatctttttatagtcacctttttaaatgaagtgtatatctcatatgataaacatcttcatattatatgtaagattaaatactatgttgattttactagatttttgtttgctctttaccacagagatttatttgaaatataaatattttgcataaagtgaatacttattttaattaatgattcatggaacatataggtcaaatcattgcaacaaatgaaatcatgataaaagtcttattatcatagattgacttcctaattcttaattttaaaacagtcctttactttcacaggaaagccaagtgacaatagtgaagtaattttgtaagttctttgtagtccatattttcattaatctcttgtacattctttgaagtagaaaatctgaacaatattttacaggtttaaaagctgttgaagatatttttacaaggctactgagtagtaaaaaataacagaatgagaagttgggttctagttttcagagaactacttgtgtttattttttaagaaataatgcgactgggcagggtggctcatgcctgtaatcccagcactttgggaggccgaggtgggcagatcacaaggttgagagatcgagaccatcctggccaacatgctaaaaccccatctctactaaaaatacaaaaattagctgagtgtggtgacatgtgcctgtagtcccagctacttgggaggctgaggcaggagaaccactttaacacgggaggcagaggttgcagtgagccaagatagtgccactgcactccatccagcctggtgacagactgaggctccatctcaaaaaaaaaacaaaacaaaaaacaaaaccgaaataatgctgtaatatactacacaattccaaatttttacttattatggcaaatagaatgttagagtataatttatattggactttgttggatttattaatgtgaatccttgaaaaatttcctactgattttaatataggtaagaccaagatctgtaaatattatttttattctgttttagtaggtaagtatatagcttctttacagtagatggacttattttttcactactattatgaattattttaataacaattttttttttttttttactttgtagagattgggtcttgctatgttgcccaggttgatcttgaactcctggcctcaaatgatcctcccacctcaacctcctgaagtgccgggattggaggcccaagccactgtgcctggccctttataaattatgttataatttcatgtaatacataattgtatagtcaaaatggctcacatattaaatattctttatacaaggaagtctcaaagagaaattacatttgaaatagtttattctaaaaagttttcaaatacttcagttacagaacttaaagtttataatgtatactaaatgttaatatttggttcgtactcaaaattttttttttaaggacaagagatgtaggttctgtgggtctaaaaataatacccatatgtgtcactatatattagttcttataataagcaattaaaaatgtataaccatatacataattactcatttttctttgatgatagtttaaataattaagaatgtgctaaatatattctgaagatgagcacaatttcaagtaataaattatgtagggctggttctaggtttaagtgaataaggagaagatagctgctgagtgctggaccagaatcccattttatttatttacttctacctgtattatgctctgggaatcagcatttcctacactataaaggaaatttccaaggcagagcagctaattttaccctggatattctcagcacctcatttctaatccttgtggcatacagttcttttattgacccctatattctcaaacacatctcccattgagctatgttcctttggggtgtacttctgtggcactctgcagtatcctcagtatctttctattatggccattggattccactggatcggatatcgggtcatttttgtagtgtttgtatgtgaatacatttatagtctcacatttggtgccattgtgttagacatagaacattctcgaaactatatttgaaagctgaatgtctggaagttgaacaataaacttacattataaggtcttgaaaaatatatatatatatatttttgagacagagttttatttccatctctcaggctggagtgcagtggtgcaatcttggctcactgcaacttcagcctcctgggctcaaaagatactcctaccttagcctcccaagtagctgggaccacaagtgcccaccagcatggccagctaattttttgtagagatggagttttgccatgttgcccaagctggtctccaactcctgagctcaagcaatccacctgcctcagcctcccaaagttctggtattaaggtgtgagtcactgtgcctggccaggtcttaaaaatatttaatgtttaactgtctttcctattggtatggcgttcttgggctaggaaattaaggatatatgtgagaactatctcaggtgacaaatgactgagacgcaggaggtggtgcttagttctgggagcctgccagccagacatcctcacttcccacaagcccattggatttttttcccttactctcatccttgttactaccatgattgtaagatgaagccgtccctaaatgtgaaattttcttataggaatgagaggctgaatgaagtaggcaaaaggcatctttgttttcttttgccatgagaggacaaggtaagggaggcttctggcagtcactctacttacacttgaggacaagcctgaagctgtctaccttttacttcttttaactcacacacacctctggctgaattcttgccgacttcttgcatatcttctaccaggcttccacccggtaatagtaagtacagcaacaaaagtggaggaaggggagaggacttggtttgctctctgccctgaaagacaatcatcttttatattaggaagctccaggcccctggcaggtcaggatttccaaggatccttcttggtagatttagacaagctagattttggaaaggagagttgttaggtatagctgtggttcagctggcagttaaaacttttgttctgttagagcctgttactactggaaaccccgtttctactaaaaatacaaaaattagctggacgtggtggtgtgtgcctgtagtcccagctaatcaggaggctgaggcaggagaatcacttgaatctgggaggcggtggttgcagtgagccaagatcgcgccactgcactccagcctggcgacagagagagaaaaaaattacttatgctttctgtaatagatgttgttggttcagtacttttgttctttcagtagtaccacgagtttcttttggagaactcttttgccaatcaaagcaattgtgcaattttatttttttaattttaatttttttttgagacagagtcttactctgtcacccaaactggagtacagtggtgtgatctcggctcactgcaacatctgcctcccgggttcatgcgattctcctgcctcagcctcctgagtagctgggattacaggcgtctgccaccacgcccggctaatttttgtatttttagtagagacggggtttcaccatgttggccaggctgctcttgaactcctgacctcaattgatccgcccgccttggcgtcccacagttctgaggttacaggcatgagccaccgcacctggcccagtcgtgcaattttgatggaagtgactgactaaatttcaggcacgggctgtgactggctttagccaatcgaaacattcccttcacctctctccttctatactgattggttgagaaacctaattgaggccaatggggttgaaaaacctaattgaaaccaatgagatgtcacagggtgttgctgggcaaattagaaatcatcttccttctgaaaccatcagacaaataggctcttttccttggaaagtgtgctgtgagcctatgagatctgcaactgttgcaatcattgtgttatcattacattacattatagccacaaagaagggaagtctgaggaagacaggtggaggaaggcagagctgagaaatctcagagaaatagagtcagagaactgataacattgtgaatctcagatctatctctgaactctgcattaccatatgatttaagctgatctaaggtggtctttttctcttcttcttccttagtgctgctcctacttttatttccatcatgaagaatcttaagtgatatagtttgtcaggataaaacccaaacttctgagcatgaaatcaaaaggtccttatgatatgattcttttctaccaatgtatgtagctccattttcagaactactactctcccctttgccttcacatctcttatatttttgatgttcttaaccatatcaaccccataaagtttctaggctaagtcacgctttcatatgcctgttttcatatacccccaaaatcttattctttctttaggattagtcttagtaagtatcctctgcaaatacttctctccctcatttaagcagatttgattattttctcctttgtgaaatcattgtgattaatatatcagcttagtttgacagatatttcttacctactaagtgctagacttggaccctgttttcaaagctctttaattctagctgggtaatatggcgtgtgttttttgtacacatcactctttattgtagttacttttgtactgagattttctgacaaaatctaatgtgctgtaatagttcatattgttaatacacatcttaagaagtttccatttgttattactacctaattctaataaaaattttattgcaaatattcattgaaaataaatataataattagttttaataatcaaatataacattttttccagatttccatgtcaaaaattatagatagtcctctgacaaaaattgggttaatattatttgtaacttggaaaacataatttttcagtaaaatggctaataattttttccctatctgacttgacctgctttttagatccttttatataagaagtagtaattcttttaaagtaaatatttctctaagagcctgctttgatagtccatacatacttttctcttctctgtagctagagcccctgtattttcagctatgccccagggttcaggactaatcctgtctatgaa

SEQ ID NO: 1103 - DNA, 5718 bp, Homo sapiens
ttgtcagttttccttctcatatgacatttgctcctaaaatacccaattttttttctgcccagacctacacacccaacccactttagctgtaccatccttagattactatgtcacaaattttaccttgttttgaaactgaagtacagtggctgattttgctatttttgcatttatttgcaaagctgaattctagtaattaccagcaaagataatcgttttgcacaaaaagaggtatatttctatcttgaaactaggttatattgttaatgccacagaaaaggaaatggctttttcagaatattagcgtttgtagctcttgcttattgatagggaaaagttagttgccatagtgatctaacagcctctggagggaatgcagtcatggccttaagcatccggcaacccacccagttgagagagcccctctgaaaaggatttccttccatggaaattgagtttctaaaataaaaagagtttattttagcttagatttgcttataggtttgttttgcacttttacctactggaattaaaggaaaaacatttataataaagacagcatatatttcttcagggatgacattaaataatagatttttgtgttaaccattccataaatgtgctctcagacacacaaaatgacctttatacttttattcttgtgagctatggagcttaaaagcaaaccacttcaaccagatgttgatccaataaatttatcaatatttggggtttttagagtttcagtatatattcttaggtagagggaactttcatggcccatcaaaatctgctcaagctgtgctgggtgaaacagcactcatctataatactcatgtaacatgagccaatctgcagtcggttgttctgaattctacatcactcacagcgcaggttgatgtgtgaacactgtatttacaggaccaaaactgcacatttgctctgcagctgtgtttaacagttatcagtttggcacacagcatgactgctttggagggagaatagacacttctcatcccttttggcatttatgaagtaaccaaagtacctactgctgaagtgattcacttgagcttaattagatttgctacataattagcatttgaagaaacctaaagaaaatccttgggggttggttatttgttatgtcaattgtaagcatgctcatttgggggggactaggaattgaaaatgatgaaatttaatgcaccataaacccagatgtattatatgcatatataattttttgaagagtttttaaaagctgtgcttcgcagggatgactgaaatgcttgtctcagacaactgagacctgtgcaaggggattgatccatcagcatgtgcccatgtctgcttgatggcgcttatgtgtgtacaactagctttacacctctcatgagagcccacagctctttaataaacaccccagtgccagccgtgagggctgtgccaataaccaccacttgaagctggagagtgcagtctgagacagtgagatcctatactgcacttgtatttacattttaaggttaatttaattgcaatggcttgttctggtatgtgttgctttaattgcaaagaaaaaaaatgaatttaattttatactcgagacatttctttaaatactcctgaagtttgttctttagtattagagttctacaaagtgaattaactgtggagaatagctgtaaaatactgagaggagaggttaaattttatattccagtttaagttaaggctaggataaaacttgtaaactatgtttatgtaaaatattttctaatctgtcaaaaagttgtcacattttaatcaaattacttagttacctaaatttgtctagccataaataaggaaataaatgagagggaacaagtttaatttattgatgaagcactctgatgattttttttacccttatagtaaaaaaaaaaaaaaaacaccttcaaacttacatcctaccatatgttcaccatcaaatctcaagtcagaatcaggttcaaatcagaattcaaaaccagttttagaactcaagtggcagctcatgccctgcatgcaggcaaacggctaggaattaatcagaaagttccacccatgtccatccttcctcttacttgctcatcttcccagcaagcactaaaaagaaaaaaaaaaaaagtacaaattcgtacggaacctactgtaactctgattaaagagatcctgtattccccaatgaccgaccccctagctcccccaaaaaggaattaaacggctaagctttttataaatgtttttaaaatccttattggacttgacataaacatgcagataattctactagtctctttttcataggtacaataatagcactaagtacagaattccccttgtatccaagcaagacttttacgaaaacttaaacctgaagtcttatgcagtgcacctaaaattaaccaggagccttggtgcatataccagcaaatgttgtacacctgtgtgatagtggtcacctcacttaacctctcccagcttcagtttcttgtctttactactacataaagttgttgaaaggattaaaggagactatataaacagctatttttatttatgattaaataatatctgtgtggttactatttagtctgggtaactaaatagctgggtttttttgttctttgtacacatgcacatattccttttttaaaacaggcatatgggcaaatacattttttttctatatgcctccatgttgtttctctggatttccgccaggatgggatgtgccaattatgcacggaattgtttgcgtgtccatgggtgcttatataagtcattatctttggtgtatgacaaatacacaaactcctgtatctctagtagcctgtaattcctaattgagggacatgattgaatttatgtagtttagccccaagtaagtagataaaaattattaagtaaatgccctggttcatctaaacaaaatatgtgactaatagctttttatatgaactatatacatttagtttacctaagtttattaataaatagtatctctgggcatttttaattttatattttatacttaactatgaaagtatccagaaccagattccagtcactaactacctcttcattaatggatcaatggttttatcagatttattagaaatttgtctatactgagcatgtaatatgtactttgtgaaaataggtataaaactgggctcatcttatcagcataccatttacccaattatgggagtaaaaaaggaggcatgtgtatttttcccctaattctgaaatgtctcccagttcttgaaatttgaatgtgaaaatgtgtgcatgcaaattaagacattcaatctgaaagacttctttgtataaaatactaaccaaatttaaagttgaaccatagggtaaatatagtagaaaagtatattttgaattctgaattttatttccattggatacaaacaataattacaattgctagatgtgttttaatgaatagtttgaactcatcatgctagcaaaaatcatctgcatataaataatagggcaatttcaagcaattttttcttacttaggtcagatattcctgccagaaacttgtttgctttgttaatttgttcaattattaaactttgagagtacaaagataaatttactaatggggttcaattaacaaatttctgattacatttccctaatgatgatagtatagaacatttatttctgctgtgctttattagtaaaattgcagtgatctggtgactggaattaaactgctgaaaaatgacttggtctgatttattcactgagcaaaaccaagctttaaaggctgtgttgctatggcacccaagattaactgttaaaaaaaaaaaaaagtttaattttagtaaaaacattggtacatctcttttggcattgtgtagataaaaatagattcccccctcccccttttcttgtcttttttatgtttagcaagtcctttgcattcttttaaacatacactaaaagaaatttagcatatttaaagagaagggaaaaagcagtaaaataaaactgttttatcaaaagattacaatttgtaaaatagcaaatatttcagtcatcattttttatatgtatatatatatactttttattttgtctaatttaatcctttcaaaaactgtctggcttctcatactttttagaaagatggtgccagagagggagaaatcactctattctggtagtttcgttttgtaattagtcttcaaacttaaaaacaggttgcaaaattgggacagtaacaagttttaggagaaatcttaatgtagctctaatctttcaaattctaaaagaatatgttttctgtttcgtgagacaaaagaattgtctggttgctttagccaggattgatttctgtcttcagaacaccatttggtggtgttaagactgctagatgaagaattttgtgggaaaaaaaaaaaaaaaagaagaaaaattgaatgctttgtatgatcatcaaaagccacttttcaggagtattttacatttcttggtgccaagcaaatcagaaatcctaccttacagagagcgatttgttcatgagatgacccagtgctgcaagtcgcttatgtttatcattatgcttccacattctaaggaaattccactttcaaacgttgccgtcagtgctttcttctataggaagaatttgaactataaaatttgagaagcttcagcgtctgtggaaatttgagagcattgccttttttcctctttattgaatgtaaagtgttttaacaaaagcatggtagcccagtacattttaaatgtcaaaacttgcacatagtgtatctcataaagaatttaaattttagactttgaacttttaaagcctcaaacatctttagaggctgactacagcaaataaacagaatgttttgcagagagatttagtgaagaaaatttttttttgccgttgtttctcacagtgctctgcaggtgaaaatggtgaggaaactttgatagttcaagactatgcaggggagaatttgaaagcagaaacaagcttttacagattttacctggaaaaacaaagtggtttatatgaggtgctagttcttacctttatgattgctaatttagattttataaaaattgaaatgagttaatattttaaaatatttaagtatggtctctggacaacaataagcacagtgtacttttttaaaaagtgactttatgtaagattataaattacagaaatgagttgtcacttccctgttgttacttatttctgattttaaaatagcaaaatttataaagctatagttttgagaaaatagtaattcatattcttaaaattgttataatctctaaattaatacataaattattgatttaatgttaaattttgattttaaaatttatttcagtttctataggtaatatattgaggttctgacaattttatattaatgtatgattttattctgacacagctgttgaatttgaactactaattatttctaagaatttgttaataccattctccaactttgttttaggcagctagattgtatccagggaaacccatttagatcagaaataacatttcgttctaacttcaaaaaataagcatccactttaaaaatggaatctgaatttaaataaaaatcctaatttaggattcagttccattctttaactagcggaaagaaatcttagcaaaaaaaaccaaaaaaa

SEQ ID NO: 1104 - DNA, 1890 bp, Homo sapiens
tactttactccatgggtataaaatgcgaaccattaacagcatttatacgtgtatggcctggaaaagttacaaactcatagatctatgtgtttctccgactgcgctattttctcctaactcttggtgtctttctgatgtagaataaatactgatttccttagtcctgtagcaagttaacaagcctgtaacgtgacagatctgtatcccaggggctgatcatagagaaaccacaaagcgatgttttagctgcgtcgagtcctcaacacgggggacttccagcctggtaccaggatagcctctctggcccagtgtgagcgaaggttcgagctgacttgccagtcccgtgctaagtctcactgaggcagggccttgctgccgcggaaaaacgtgtggacagaggaacgcgccggtcggatgtgggccacagtgagccgcggcgtggaaacggccgaaatgtgcgggcgcgttgtccatgtttggtcgtggagctgcccgcgggcgcgggaacagcgcgtcgggggcgggtgggcttgggtgtccgtggcggaggttaccccgggccccacgcgcccgctctctcccggccttggtctttgtccccgcgcccccgcaagggccgcccgccgcgccccgcagcccctgagcccccgtgcgcggaggcggggcctggccaaggggacagcgggcggcagacgcgcccctgcggctcccaggccgcccgggccgcgctccccgcggggaaagaggccgcaggcgcggggaggctcggccccgccccgccacgtccccctcccggcccgggccccgcggccgccgaggccgccccctcgcgggcggagcgggcgctgggctcgcgcggctgcggcggcggcggcgggcccggggttgccatggtaaccggcagcagcagccgccacagcagggccggccccagcgccagcgccggtcgcggtcgggctcagctcagtgtgtggtgagcggcggcggcgcggccgggccggggagcgggcgcggcccggcggcctcagcatggaggacggcttctccagctacagcagcctgtacgacacgtcctcgctgctccagttctgcaacggtgaggggcggccgcgcggggccggggcggcgagcggctggtggcgggcggcggcgacggcgacggcggggaccaagccgaggggccgaggcccggcggccgcgggcgaggccgcgcaaagttgttgcggaggggcgcgcggtccccgttcccgccgccggcgcattgtgttggagccgcggggccgcgcctcgctccgggccgccccgggctccccgccgccaccccggctcccggcactggcgcgcggaccccgccggctccagcacccgcggagcgcgcccgggcggaggcgcgtggggcacagggcggcggggaggcccgggcagcctccgcgttccggggaacgtgttgcttttttgcttcccgacccacatctgtttggaaatgactggatgaagaactcgggaaacaaatcctttaataacaaaaccctcctgcgaggatgcacgcagtgtttggacccccagaacccattcaggtctactttaatgaaatcatcacaatttaatacaatctagagctttttaaatggaaagccaaagtggacctggcctcagtgttgcttcttattttgtttatgggataatggattcttttttctttttttgtttttgcaattttacaggaaggaaacattcatatccaccaatatggcatctttttaaaaatatgaaatcctacatgcttgaaagatttcagtctcattggcagggttgaaaaagattttcatagcacactgaatattttatcagaacatgatgtgtgataattcacgcacaaaagttaaccac

SEQ ID NO: 1105 - DNA, 4381 bp, Homo sapiens
actttccccaaagatcttttttaatgctgtgtagattatacctaagtgacttaacatgcatatcattgtaattattctaaatttagcttttttttagagtaagattttaccactgtgggaaaaacatagctgtttaatactctaggttaagagagcaatgatcttctttatcatctcaaaagaaagtggactgagttcttaattgtcttatttgtaactttagtggaaataatatcttctaagaaaatctccagctcaatttggcagctgaagttttaaatatatgtctcctttcccatgtctaaattgtggccaccaaatatcataacattaaacataaggaatgctaacattctttttttctttttaagatcgggtctcactctgttgcccaggctggagttgagcattgccccagctgcactgtatggaatgcagtggtgcaatcatagctcactgcagcctcaacctcctgggcccaagtcgtcctcgcacctcagcctcccaaataactaggactacaggcacacaccaccacacccggctttaaagaaaaccatcttctaattattcatgattattacttccttttcaagttcagaaataccacacctcagctttttatgccaatcatccaacatatcctgaagtataaaactgcaaagtggaatagagagagcatgaacactggaatagacagatgggaaatgaggaagatgaaatgtgcatctgggtgttaagtctcaccctttgaaagccgcttctccatagcacctgcctgctgccttagagaggcagagaacccacctgtgccaggcgggcgcaagaggacactttacctggccctctgccaactttggcccctccccccatttcctttccctgccaaagttttctttttttcttttcctttttttttgtgacagggtcttactctgtcatctaggctggagtgcagtggtgtgatcttggctcactgcaacctctacctcctgggctcaggtgattctcccacctcagcttcccaaatagctaggactataggtgcacaccaccatgtctggctaattttttgtattttttttggtagagacggggtttcccatgttgcccaggctggtcttgaactcctgaattcaggcaatctgcccacctcggcctcccaaaatgctagaattacaggcataagccccgccctcggcctccctgccaaagtgttctaacgtgcatgtacctgccctctccctttgatatccagcaacctattgcatcaccagggtgctccaggtcacctgggagccctctgccaccagacagaagagcctcaccccagcctcatcctccttgactcttcctgcagagaactctacgcaaatgcccactggaagctttctgtgctcttagcttagagagacaatgtcctctgctgattctcctgcctctctgaccattccttcggaatgtccttctctctcctttgtcaaggctgtaccccagcccctgtccgattttctattctcttctttagagacttcatctacaacccctttgctgacaactcccaaatctcaattctttctctccagttgctacagggcacttctaattggaggttgtgctgtccccgcttgaccttcctgtctttccagctgtatggtcctatagcaacttccctctggccggcccttggtgcctcatttctggagcactgcagacatcctgggctgttccagcaacaggccgcggcccctgcagcccagtcggcaggcagacccagctccctaacacagctctcaacagtggcctgcctgcgtgaaccctccaagcgttcctccatctccccccaagtctggttcaggctcctctgcagctcttggggcctctcttacctggccccttgccctcagtccagtcttatttcccacttgtctgcacaatgtctgcaggcaccgttccttctttcctcactagcagtgtcctgcccactgtcctccatccaccaagtcacagtcaaacccgcagcacctgtggcccttcagccttcactcacaatgtatcttcccaattaacaatcctgctaggacaggaataagctcttaaacttctccctctgcccacagcatatagcaccagtccttactaacccatgcactaaccgtgccgcacgcagagtgacagagccctgtccctcacctgccatctactgatgtccaagctgggcttctggaaggacaggcctctgagcccaagcgagacctacgagttttcctaattttaacttactcagttcttatttcacctactctattcaacctgcacaagttagtacctaccatttcagattttggcatggaactgaattatgactgatgcaacaggaagtgtaaacgttctgcagtctctttgggaccaagctcattcttgggttagatgatccattttatatattctaatttattgcttcccactcgttatttggcgcatctttacttactttactccatgggtataaaatgcgaaccattaacagcatttatacgtgtatggcctggaaaagttacaaactcatagatctatgtgtttctccgactgcgctattttctcctaactcttggtgtctttctgatgtagaataaatactgatttccttagtcctgtagcaagttaacaagcctgtaacgtgacagatctgtatcccaggggctgatcatagagaaaccacaaagcgatgttttagctgcgtcgagtcctcaacacgggggacttccagcctggtaccaggatagcctctctggcccagtgtgagcgaaggttcgagctgacttgccagtcccgtgctaagtctcactgaggcagggccttgctgccgcggaaaaacgtgtggacagaggaacgcgccggtcggatgtgggccacagtgagccgcggcgtggaaacggccgaaatgtgcgggcgcgttgtccatgtttggtcgtggagctgcccgcgggcgcgggaacagcgcgtcgggggcgggtgggcttgggtgtccgtggcggaggttaccccgggccccacgcgcccgctctctcccggccttggtctttgtccccgcgcccccgcaagggccgcccgccgcgccccgcagcccctgagcccccgtgcgcggaggcggggcctggccaaggggacagcgggcggcagacgcgcccctgcggctcccaggccgcccgggccgcgctccccgcggggaaagaggccgcaggcgcggggaggctcggccccgccccgccacgtccccctcccggcccgggccccgcggccgccgaggccgccccctcgcgggcggagcgggcgctgggctcgcgcggctgcggcggcggcggcgggcccggggttgccatggtaaccggcagcagcagccgccacagcagggccggccccagcgccagcgccggtcgcggtcgggctcagctcagtgtgtggtgagcggcggcggcgcggccgggccggggagcgggcgcggcccggcggcctcagcatggaggacggcttctccagctacagcagcctgtacgacacgtcctcgctgctccagttctgcaacggtgaggggcggccgcgcggggccggggcggcgagcggctggtggcgggcggcggcgacggcgacggcggggaccaagccgaggggccgaggcccggcggccgcgggcgaggccgcgcaaagttgttgcggaggggcgcgcggtccccgttcccgccgccggcgcattgtgttggagccgcggggccgcgcctcgctccgggccgccccgggctccccgccgccaccccggctcccggcactggcgcgcggaccccgccggctccagcacccgcggagcgcgcccgggcggaggcgcgtggggcacagggcggcggggaggcccgggcagcctccgcgttccggggaacgtgttgcttttttgcttcccgacccacatctgtttggaaatgactggatgaagaactcgggaaacaaatcctttaataacaaaaccctcctgcgaggatgcacgcagtgtttggacccccagaacccattcaggtctactttaatgaaatcatcacaatttaatacaatctagagctttttaaatggaaagccaaagtggacctggcctcagtgttgcttcttattttgtttatgggataatggattcttttttctttttttgtttttgcaattttacaggaaggaaacattcatatccaccaatatggcatctttttaaaaatatgaaatcctacatgcttgaaagatttcagtctcattggcagggttgaaaaagattttcatagcacactgaatattttatcagaacatgatgtgtgataattcacgcacaaaagttaaccac

SEQ ID NO: 1106 - DNA, 2722 bp, Homo sapiens
aagcctggtaacatttaagcataaggggatatcattagttgtttttgaaagacgtagtttataataatcacctggtgatgatttagcccttaaggaaagtgttaacgtcttcatctaatactacagcctagtagcttgaaagggtcaggtaactttcaaatccttgcctcatacttcgtagtgatggagggttggagaggatttggtttgttaaaccagactttttctttctctgactctccttcatccagaaaaggaggagactaccatttccagttggttggaggagggtctcttgcataagcaagggccctcaaagcatgggcattggttagcaattgagatggggttgccagattaagccaacaaaattttaggaagctcaattaaatttgagtttcaggtaaataatttttgtcataagtgtattccatgcaaaataaggataaatatgtaatatacatataaatattgcatgggacatacttgtactaagaaattagttactgcttacctgaaatgccagtttaacaaggttttctatattttatctggcaaccctaatttggggtatactgcaggtctgcctttgaaaataccggttgggacctccgagtggactggcagaactggaagaggcaatttatcacagacctgtgttgctttatttaccctcatggctggcccttggtagtcagagaagagccctgatatactgatgcaggatgagcttgatcactcgtctcctagcaaccgcacagctagtggaagggagactgctgacccagagatggttctgtgttgaatctagccttgcaggaaggcagcaaaggaaaggctttttgactatacctcttcttttgtcttgaagggaaaaagcaaattaagtgtttttatttgaaatttaattgtgcattcagtatatttttaaaacaatttttgggaaaataacctaaatgtccaaattatagtaatcatggataattattattctcttagagaaataaattgtcctggaaatgtaaagcagacaagcgatgtgaaaactagacaataagcagttatacatagggatttacagtaatctattcttgccacttttctaaacaattataagtaatatttaatactaaaggaaaatgttcatgatataatagatgaagaaagataagataacctgttcattattattctggtattgttttttctaagcacatttgtgtaaagattggtaggatatatatcaaatgttagcctagaaattgggaagatttaaaaattttctgtatccatattttctaaatttcctataacaagtacactacatttgaaatagggaacataaaatttttaaattgtaaaatcatcttttgaaagaattttttaagttaaatttagtttctataatgttcctaatttggagaattaactgaacccagtttttagagctgaaaatggtctcaggatcacaaagccaagtggtacctcaagttaaatgtcatgagatttgtttgtcacaaaatagacatagtttttgtagcttacctgagagtctccctctagctctgtgtctcagaatgtcaggtcggcagtttacttcggcagcccgttatgcattaggaagctcggctatctctagtcatgcatttcattcagcgaggtccatttagtatatgataccccttatgtattaaaatataattgtacatgtttatagagtatagtgtgatgtttcagtacatgtatacattgtataatcaagtcagggcagctatcacatccatcacctcaaatatttatcagttcttaagatcagttacttattcctctttacagtgtatgaaatgttttgttttttcatggaagaaattttgacatttgtgttgttttcatacagccgatggaaaatgtctggtgtcggttggtttagacgattttcacagtattgtattttgggactggaaaaagggagaaaagatagccacaacaaggtaagaagctgccgggatcttacggtatcctgctgataccacggttcagtaaaggtcaatagttttcattttctggtaagatttcatcttcaaactcaggtgaaattgacgtagaaggcttagcacctaagtgaaaaaatactgcagtatttcatggtgccaaacctgacttagagcaggtcatgtttgttgcggtgaatcagaaaattccgaaatcctctgcagagagtcattcaccgcttcattttgagtggtctgtgtaatctgtatcaaagcacttcagcaatagaaaagcagcttttctcaggctggtgccttgccccttgtttttcttctgtcctagcatctggtgaaggattgtcaatgtcaccagaatcagaagcaccgtttgtcatgaggctgcagcatgctggaaaggaggccccaccgtgtgcatctgccacttgctttcaaagcaggcaaattgtttccctaatcttccgtcttataaatagattttttgagaccgactgctgtttatagaccacctgtcctcccttaccccagccttcctgcctgctgaatcagcactaagtctgaacacgactttccactcctacttacattgagctcagctgtttgcccaaccctgatcaggggtcaaaatagttggcagccaaggcccagcaatacaatttgttgccgaggcgtgttgtcagtgtacctccctgctcgttcttctctgcattaat

SEQ ID NO: 1107 - DNA, 10677 bp, Homo sapiens
aaaagtcaaaattccaaactcacctaaagcatatttttttccttccgcagtagactttgggcttgttgccagtctctcctgcttagctcaggctaaaacggtcatgtctctctttttttttttttttttttttaaagtctgggccgggcacagtggctcacgcctgtaatcccagcactgtgggaggcggaggagggtggatcaccagaggtcaggagttcgagacgtgcctgaccaacgtggaaaaaccccatctctactaaacatataaaattagctggctgtggtgcacatgcctgtaatcccagctacttgagaggctgaggcaggagaattgcttaaacccgggaggtggaggttgtggtgagccgagatcaagccattgcactccagcctgggcaacaagagcgaaactctgtctcaaaaaaaaaaaagaagaagtcttaggctaagcatggtggggcaagccggttatcccagcactttgggaagccgaggcaggaggatggcttgagagcagcctggacaatatagggagaccttgtctctaccaaaaatttaaaagcctgatgtggtggtttagttgcttgggaggctgagataaaaggatcacttgagcctgggaggtcaaggctgcagtgagccatgatcatgccactgtactccagcctgggccatagagcaagactctgtctttaaaaaaaaaaaaaaaaaaaaaaaaaaaaagtagaaaagttagtttttaatgcttaaattatattgccttagctccaacttagtgtagtttactttataaattatggataactgtagatactgtgatatttatagttttagtcactgatttgttagattttatccagttattcagctgttttacctgggtagatgacatgtacacagccatcttctaaaaaaagtttcaagcaacagtgtttttatatactctatcaatcaaactttgtgcattaattaaatactgtttgtatttaaatcattatggaatctctgacttctacaagagttgggtcaatgagaatcaaagcaaaacttggctccccttggatttcctcttacgtataaaacctctttatacgtaaagaggtttgctttaatcccacttctgacaccaatctgcttcgtcctcacaggacagtgatgttagtgatgtgaatgatggaaaagtgattgtataaaagttaggtggggccaggtgctgtggctcacgcctgtaatcctagcacattgggaggccgaggcgggcagatcacctgaggtcaggagttcgagaccagcctggccaacatggcaaaactttgtctctactaaaaatacaaaaattagctaggcatggtggcgggcacctgtaatcacagctactcgggaggctgagggaggagaattacttgaatcactccagcctgggcaacaagagcaaaactccatctcaaaaaaaagttagatgaagtttctgtaattttagggtatgcagaaagctatagatacagttacataaggcaggagctaatagcaatttttaggcggcactgttagggcttcccaagtccctctcatgcctcagtgagacatacagccatgcttattggcatttttccaagcacaagaggcttcctttatttctctgagatgtattttatacttttctaccatctcctcctgaaacacatacccaaatgtttagcagaatctgagtacatgcctaccagctcccacagtataagtaactactacaaaacagttctaacatactttgacacgtccactatgggaactaactgactttggcttcaacagaaccctgcctcaggcccaggcttcacgctgtctgaggttctcttcagcacaatgtgatgggttccttggacatcttctggctgcacctgttcggatctctgagaagattttgtttgtctttgttctgttttgccaagtctgagattggcactggggaaaattgcctttctgagggctttatttttggtttccgtattatctcatttctgttggtgggagacctgggagttgccttaagaactgaacaatcacaggcccttgctgttgacctgatcagggttacacgtaaagctctcctctcccaagtaggttgtcaactctgtgaaagcaaaatttctgttttatacactgctttatctctataatctagaacatgctggcacttagtaaatgtgtgttgaatgaataaatggattccttaacaacaagatttagattcattttcattctagcccatggattagatatcaaattctgagatcttgttgacactttgtcattaaaatccataatccagctaggaaatctctgcttctaagcagttggcctccctggtcatccttccagcgctcaggctgcagcattctccatctggcttctgcctttaggcaattccaagtagtggtctgaagtggagaagcccttgccccagactgcatctcagtggtgttgagggtagttgtctgctttgtctggcagggaatgtgtgatagtggatgtttaggaggggtctagaggatcaggcaactctcctttctctgtcatacttgctgtaagtttacttccatgtggatggatgagtactgcttccaacagtccccatggacgaggactcatttccaagtaccagtagccccttgtgatatgcacccatatttggctgatcgcagctgtcagcattccatcattttcaatagcccccacttgtggaccagcaggcatgtcataatcctgaagggtgatccttatcctccccgctccctgcagtgcccctgcctgggttctgctctgtctctcttgaccctccctccaggcaacagcagaggctaacaactttcatacaagagatggttgtcctggtttaatgagatttgggcatcccatacaagtctaggggtgtgtcccaagtggaattcctctcccaattctctgtgaagagaggggaaaggaaccatttcacttcacaaactgccttccactatagaggcaacttaactctccagccatctcagcggcccggcacaagcaaacacgaggaggcggtgccagaattattcttagcagcagattataaaggaggaatctgtgaatattctgcattaatattttagtccttgtggaatatattcactgtcaatctatggcatatgttccttaggaaaccaaggaacttttaccaaaccaaaattagaagtagtttctaagccttttataaatggtggtgcccttacctgtgaactgacaggcgctagcaccaaatgacctcaaaattccactgtagtattagcattttccagaatttttattagactgtgcttacagttgaatggataaggcattaaaacctatcttccacctcattctttctgagttgatttgaatgggtttatgaactgaaacaaaaagaaagttctataaagaaaactatatactgtgggcttaaaaaaattttatggggtttcagagattttttttgtttgttttggtcatgttttggtttcaactctaaattaatagccttctttaatccttgattccttaatttattagtctgtggcgtcaatataaaatttcactggattataaactgtgtaggattatcagttccccagtggctggtactgtacctatcatgggaccactgtgtgtctaacgtggtaccttacacttaatacacagcaaacaaatacttttcaaatgaatagatgaatggaccaatttacttagcctgattctcttaatatttaatctgtcttcaagatgctgtgcaagtccattcttggtcagcgaccacttttaccttcacttcattagcaactatggatggtctttgtgggaaatgatgtgactgatgtagaatccagggtgccccagttggccctgggactgcacttggcaaaatgactttttgatctttgtagtatctgtccttcaggaattacaatgtttgtttggtttaaatctgtttaaccccaggcaaaaggaatcaagaagattctgtgtcactgtggctatcatgcctattgtacacaccaaggtgctttgtcagcaggtttacaatgaaacaaagaacatgctcataagtgactacgagaaaacgggaaggatgtagacaggtttccttcagtcaccaaatcaccgtatataagtaatcccagttttccttctaaccttttatgctgtgcttggaaacagaaatctgggagaagttgcccccagtttgtatttagtttctaattttttaattgacatgcaataattttatatgtttataaggtacatagtttcaatattttcaatgtatagtggtcaaattggtatcattagcatatctttcacctcgaacatttgtcatttatttctgttgggaccattcaaaatcctctcttctgctgttcactcatatgtggaagctgcccccagttttttttaaacgccttatttaatcaggagatctgtgggaatttcaagctcgcctgaggcatgatgagcatggtgaagtggcacagtgtcaacggcaaatgagcaacctgtgctcccagctccttcctcagcgtagccggacagaggccctttgttgtcattgatcaatagctgttttgtgggcctgtattgttagagttgctaagaactgaccatcctgctaagctaatgctgctggatttaccatatagagattgatgaaaactgctcaatcctatcttgaagcttggcccaataaatggggaggaacttctagttctacatttccatcccgtttccaaggctggagtgagcttacagagcctgagagttggtacagagatctgcagttgcatgtgtgttgtttaagctgagcccagctctccccatgggagagtgatggcacacgcgtagtgcacgcagggcgaggagcactcctgctccagagcccttctctcgaagctgcgttcttcttcatcccaccccttcgttctgcaagagttctgcccgcatagctgcagcgagcaggtagaaatgcaagactcctgttctttatgaagttggaagggactgaaattataatatctattaaacccagaaatgctgaaattaatcatctccaaggcctattgcttagttaggtaactccactaaaagctgaatcattcgttgatttttttctaagtgaatatgatgctattttcataaatgattttctttattcaaaccccttgattttctgtattggtttgaagcaaagcaatgacttctgtctgataattttaggcattaaacctgctgttcattatagaatagtttcttcacttttgatgacaaagagtggccagtgtataaaaatccagaagtaaagtgttggaaaatgatttttagaagcttaatgtgcctaggaaatcacactcccacagtgtaatcatcaaatcaaacctactcacttatggagataaaagaacacttcaaaaatatgtaagcacttttctgtcaaaagggagtgactctccgaagactgtggcagagttgggtctgattcttttaggcaagtgtctgaacatctcacagattctccatctggggggaatgggcactaccaggggtgttgatctgcctcctgtcaattagtgtgtggtcaggatgtggtaaccgaggaggcatttgcaggagtggaaggtgtgaaggatcagggtgctcttgtgggtgtgtttaaactatgttggcgtgctctttacccgactccctctcgctcatttgaagttcgtgtcatgctctgccatcttctgccccttcctgttcttgtcatctgtcaacttcctgtctctgagcaattcagctcatggtcaactggccaaccccagccagctcctgccatgccctgggttacatcatcaccaggaactcctttgtccctcagtgtcttaaccagctgtcctctggatttctcattcccgggtacacctgatcttcatcaagacaaataagtgcctagacaccttcatttttccccaagttcatcagcccttcctggcctcactttttgtgcctacccaaatgccatttcccagtcctgttggcccttctcccctacattcctcctaccacctgcctctccactcttcttataggaagtcccacgttggcacagatggccaccaccagagaggctgcctggctgctgcacatggccctccaagctcctccatcctttcctttggttggttttctctgctgcttctcagcagtcatccaggtttcaactcaacctcctgcccctccttcactgagaaaacagaagccactggcacgcattccatcttggtgcttctttctctctcctccattttgcttcccatccttcactcacgtaagccattcaccttcttccctctcttctcagaggaagtaagtcccttctcctattcaagacagttccctcacctggtgcttggccccggcctcctgtccatccatgctccctcatctgtgtctcctgtgtcactctcccacagccagatccatgtcctcaaccaaaaaatacatcccagtttcccacctccacccagctctcctcaggaaaaaaaacaggtcctttgattaatcttataaacttacacatttctgccgtcaccttccttccaacctttttcctttctcattcaggccttgtagtcttttcttcattctctatcctatctcatctgtcctctgtccctgccattctgctgacatgggggctctttaacccctgagtccagtgactctcctctctctgtcttactaagagaacttgtttcttctagagtagcattgtccagtagaaatatgtgagccacgtgtataaattttctagcaggcacattaaaaaagttgagatggtgacattgattttaacaatatattttaactcgatatattaaaaaatatttcaacatgtaatataaaattatattttacattctgttaaaaacttttcagtaggacttcaaattccagtgtgtattttatagttatagcacaattcaaacttttgaaagccacatgtggcattggctactgaattggacagtgcgtgttagagaagaatataaacgttcttctctcgcctttttgaaagaatctctcttggcccttctggtgcctccctctctcttctcagtgtctcacctctgcttcctcttccagccccttacatgctgttggtcctcaggattttacctttggctggcatcttttcaccctctaccatctaccctctctcttaattaatcttttatatcccacccattggctagtgattcccagggtcatgtcactgactcccatctctcagtggaacttccaactaacaaagctatctcacgggtgttcaaagctcaacgtgccaaaattgaactcatcatcttccctcattgatattttctctctgtctcattccatgatacaaccatctgtccagatatgcaagctggaaaactggtattgcccttgagttgcttttcctacttcatcccctaaagactctccatgacaaagtgctgtgaagtctatttcgccaacctttctttaaatattcacctgttttcttctccataaccactgctccagtcaagtgcttcatcattcctctcttggatcatcacagtggcctcttcagtattctgcccatctttacttagttccctttacgccaccctttgtactctcattttttcacccaaataactttgtattcacctaaaatagccaagtctaagacgatatccccattttttaaaacaacaacaaaaagacacaaagctgtgtgataggcttcagtcaagagcattttcaagagggtaggcttctttcaggacatcctgcagttcttctgcctgaatcctttccatcaccccatcactaagtatctctgtacatgattctggaagacataggaatacactcaacagagtccagttcttaggaatactgttaacagagtccagttctgaagaatgcacttgacacagtccagtttggtcttgataacagagaggccccctggctttggagatttttcctaaccctggatttatcctagagcagtggttgctaatttctctgtgtttctcgcccctccctttctccctcccctcccccatccattcctccctacccccctccttccctcctccttcactccttccctcctccctctctgcctcccccttctcccattcctccctctctccctcctctcccactcctccctctctcctcccatcccattcctccctccctcatccctccctacccctcctccccctcccctctttccccctcccctctctcccctcccccttctctctcccttctctctctccctcccccttctctctcccctctctctctccctcccccttctctctcccctctctctctgcctcccccttctctctcccctccccctcccctttggatttcccaagacattctaaaaccattggagcattttatgccacattttggaagctgaagaaagctgtttcctccaaggacactttgaacattgtctgatgaacacgactcaaaacaacttcaaacttgaatttcttggctagttggaactgagtttccccacactcacacccacacccacacccctctttatagaaactggttggaacgacttggtttctcacaggctgtccaagcctcactccccagttggctctcatgttgtactcatcttgggttgcaactgactcgtgacctcagtggtttcagaagcttccctgagcactttggccctgaatgctcttacacatttcaggtcattgtgtgctctgctccacctcttgctctgtcagcccagtgccttggggagggggaaaggagggacaagtacccaggcattggcctgccttgcgggtctgtgcagggcaagagcccgtgtcaggataagactccccacatctttagttgagtctaagctttctcttcagcagcccagcgctgggcagtgggatgacagcaggaattggccttcccatgatcctgccctgcccacagaatgtgccaactgtttccacagggggtacagggttgtgactctccccacaggcactgaagagcagggccgacttgttactcaacaccaagccccaggctggagttcacagcctctccctgggcttcctgccttcactctgtcttcttggcaggcttctcctgctctccagagcttcggcctgtgtgccaccctctctcctgattatccagtttgtttgctgtcttgccaggctccctccttaaatttcttgccaatggaagctctttctcctttgttccctgaccctgcccccctgcccattctcctcaaagcctacttgccccaccaggcccctttgtgtctctgctcctcccacctccagtctctcaccccctcaccttcccagatcttggccccactgggtctccctgccaatgccgggttgtgcccacagccttcctcgcactcctgtcctgtgccagctgggaatgaccaactctaatgagctgattggactgaaagtgagtgaatgtcctcatgcctccactccttcccacctcagcaaagcttttcagagtcccatttctgatggaatctgaatctagaaggatttagatccacggaaaactgttaaacctccagtgtttggctacgtgtgaagtctctggcagtccctcccacatctgatgttatgaacactgtttatagatgcctggaaagaagcttttaatacttgtattgtgttttaacttgctttcctttggaggcagggaattgtcaagtaagtattcacaccgctctggagacaaacacaggtgtttggtgaacatccagtactaagtgttcacgcagaatccacaaccgcgaagggtcaatacttaaaatccgctgaatttgccacaatgcaggtttcttccccttgctcctctcatcttcagttttgaagcaatacagctgtaaacatatgcttgcgaaatgagaaagaaacattgagattgctttacctttcggtttttttctgaaaatcaaggtgaaaaaaaaaagcatcggattgcgtctgtgtatatatatacaatctcctgtatatataaatacacggtgtttgtgcttgtacgcatactctatattcactgtataatatattacatattatacaacctgtgtgtcccctgaaatcgagccctgtgtttatcctcaaataatgccttatgagccatgccatagttccagtgtcctcttgctctcctcatagcccctggcttgcttttgtcatacacttaaacgttcttaggtgaaagaagaaacccacggatttcatttgaaagtcccactaaaacagaagaaagagcagatgtcctgggaagcgataattaatgtgaaggaagtgtctaattgtgagaactggcatgcccccagtctcccgattttgctcaatttggtggcgatgatgtcagccgggggtgtcgttttgcagagatgtgctgtctacccattcttcagtggtgattataataccgtttggtccaattatcacttatgattacataacgtgttttgattgaagagtttctgagaaaataaaggtaccctgtcttcccctgcacacaaaaagaacccccgcaagccattcgagcaggcag

SEQ ID NO: 1108 - DNA, 44124 bp, Homo sapiens
agttccatagacttaacgctgaatccaatggttagtaacattggctttctattcccttctccatccgccccaccccctttgccacttgcttacatttcttaataaaatgaggcaggtttgctatctttttgctttttattctttcttatatccatcatctgttatcctttctctttcatgtgttctgtctctgcttaattccttcagcactttggttttattccaataaatagcttctggaagatacttgcgtaaacaaacaaaaacagcaaaaacaatgaaacatttaatttttagcaagtgttatggtgacctttagaaagaatgtgctttccggccgggcgcggtggctcacgcttgtaatcccagcactttgggaggccaaggcgggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccgggaggcggagcttgcagtgagccgagattacgccactgcactcccgcctgggccacagagcgagacttcgtctcaaaaaaaaaaaaaaaaaaaaaaaaaaaaaaaaaaagaaaaagaatgtgctttccaaagtagacatgggtgggacgtaactggcccacctgatgttgtcttccgtacttgtattggttttcttctcttcttctgtcatgtgccagatactgtattggatgctttacaaactctaccttatttaattatatcctcatgatatccagaagggagttaatattctcatcttgcagatgagcaaactaaggctcagacatggtcctaataggtagaatagaaggaatttgaatccagagttaactccagcacacatgctgctttccttaccagggcttgcttctacctaaatagtaagtacagggagagctttatgacacagaatatctacaaatactgattgacttctctggctcttggacccaaatgagaatgagcttcatggtatgtgtgtgtggtggggattcatcttatttttgcaatgcgtatatgtgttgtatttttaaatgatgaaaaatgcacaggtaacctgtacaagagggagatctaagaatagtcagcattaagtaaatatttgttcaaagaatgtcttccgatgacattgcataatttcagttcatatatctgaaaacttagtaatgactagtgatttttataagagagattgaatagtgggcacttatttctaatgagccaattgaaaagcaaattagataacttgctgtgtgtatggtgacaattcatccactttctattttctctcccactgtcttcccacatatgtatatattgttttcattgacatattagtgagttaactaggttaatttttattgtgcccagaaaatacttaggtaatttcagattcattgtggagcggggaagcaccctaactctgtgagctgtactctgaattgcagagtaagtttacaactagtgggaaatataaacattgacaatatttgcactcttaatctgtgtgtacaacaccatactctattgtcaccacccatttcacggctggagggtccattcttgtatcattcagataccagcatttggaagccaaggacctacattttaatagacttagaagcaagaaactggttatatttttgacgtacttatcaccaggctttcccacagttgatcattcacatccatattagtatcaggaccctattgtgtatagaggacattggtaacttaattttcctttttttttttttttttttgagacggagttacgctctgtcgcccaggctggagtgcagtggcgcgatcttggctcactgcaagctccgcctcccaggttcacaccattctcctgcctcagcctcccgagtagctgggactacaggcgcctgccaccgcgcccagctaattttttgtatttttagtagagacggggtttcaccatgttagccaggatggtctcgatctcctgacctcgtgatccgcccgcctcggcctcccaaagtgctggaattacaggcgtgagccaccgcgcccggccggtaacttaattttcaaactttgaagcaaacagtcacaggcctaagttattgcattatcaccattcagcatttcttctgaataaatattacaaaaaatataataggtgtgaagagaaattcagagaggtgagggaggacgtgtagggttttcagctttatttcctgcttctcctgagttgcacgtgggaacacagatgatgccagtacatgcctgatcgggaagtgacggcacagttacagtcctgccggtatgctcacgcaagtgggtctttttctcatctcttttgaagataatttattgggaaggtgcctacattctgtccagtttgatttcaacagtggtttgccaaaatgagaatgagtccgaatttctcactgaaatctatgtatcttcaaaattaagaaatccagcagtactaccccttcctcttgtacctgtgatacaagtttatccatcattgttggagttcaccagcaatgtaaaccctgaagttgatcagtttgtccccacttctagttccagtcagtggattctataattagaagaaagaatggctgaggtactataataaaatatttaccttaaacaaagccacaccggtatcccttttgttcttctctccatggctctgggtaaacactataactgtgatgttagcctgcaggctagagccaagagaactgaagattgacaaaaaaaaatgatactggaggttcagtagtgtccaccctaccgtttgccctccgcttgtgaagtccagccctggattatactacaaagtagctgtgctcttggacaagtcatttctcctctctggctttggttttcttcatatctgtaaactgagagggtgggatgagattttacttgagtttccttttagttctgattctatgaaggagtaacatgtcttgtttgactcagaaaatcctggcgatctctttcaggcttattgtagtgtttattacagcaagctctttagaagcttccgcataagcagacatcagaatgcgcctggacctcccaaagtcatctggttttcttcagttttttaaaagttcagaaatgtgatttgtagaaggagtaatagaagggagtataaattacagtgggaaatgggaaaacattcatcttaaagccatatatttctctgtacccttttgacatgtaatattttcttatttctattgtgttgggcagaatgaaaaatgggtctcgatatattttgtccctttaattgtagcctaatttattaatgccccctgggcttcccctatattattggtggcagtttctctttttagtaagtcattatgcagatctttggggatgactgtcaaaatgcttaataaaaacttgatagctaagctaacttttgatttggggctttgaataggcatccgatgcccctgcaatctcactcctagatatctgaccaagtggaaaacttattttcacacaaaagcctgtctgtaaatgttgatagcggctatatttgtgattgccagacacaaggggcacaggggaaatttggaggtgatagaactgttgcgtatctgcattactgtggtggttacatgatcacagatgtttcaaaactcacagaactgtacactaaagggtgaattttcctgtatgtaatttatacctcaatttaaaaatgtgaaaaaatactgctaaaaaagtttatttgaagtattttttatacctaatactatgggcactttgggataaaatagaaatacgctatagaaatacgacattgttcacaagggccttttaaggagattgaaatttaggatttctaaaaagatgttatgaggacatacggattattggaagtagtagttacttctgtcagacaacagaggagttataaaaagcaaaaaaaagaaatgatttttaaagttatagcatctgagctttttcttaaagttggtttaaagtttttgatctttaggcttggtggagtggctctcaactataatctcagcactttaggaggctgaggcaggcagattgcatgaggccaggagtttgagaccagtctcgtcaacatcgtgtaactccatctctacaaaattacaaaaattagctgggtgtagtggtgcatgcctgtaatctcagctactagggaggctgaggcaggagaattgcttgaactcagtaggtagaggctgcagtgagccaaatttgcaccactgcattccagcctgggcaacagagcaagactgtcacaaaataaaatttttgatctttcagcgtttgcagggcagtagaggggaggagaaccaagtcataaaacacggatcaactttattttcctgaagaagtataaggtaaatatgtatgagtaggcttttttttttttttttttgggtcccagcatatcgtaactacttttgacaatccctgtttctaataaaatgtatgcaagcatatctttgtatatttaattttttctgtgcaattcaaggaaggcaaatggttactatgaacactaaatcctgtcgaacttcctcacacgcccgcaacataggcaattgtttcaaaggctgtggaagagactgccagttgcctaccaaatatctattcttcccttccttagcaacagtaccccagttcttttcaggaaagcaatgtccctgtaggaaacattggccagttttcctttgagccagatgtggctggtgactacataagtgttgtggacttccaggaagcggggctggtttggtgagtaggggcagcagtggcagaacttccccaactcccacctcctggtgcctggaatgcagctgtgatggctggaactccctggaactccagcctaggtcttttctcttccttcccctagcccctcaatagcctactaggagacagttctccttctcaaagagaaagtgtctacttgacagttgatggaacagttgttactggtttccctgaaatagctcttcggtcaattcccttgcctcacctcatctaataaacatgaaaactgacccttaataagcattttccactttgctggcagtgtactaagtatattccatatattatctcaaataaatcttatcccagtgaagtaagttgtgttattatccccatttcggacaaatataaaggctaagatagattaggcagctggccctgctgcttggtcatgcagcaggggagctgggatttcagcagaggcctgttggcttctggactgtgccattacactcagctgcctattcatctttactcaagtccctgttaatgtaggtcactcagaggcattaaaacaccaattcatggatttctatcgcccttttctctgttcttattattgatattatacaaatttttcttagcaaaattcttaatttgaccccttgctgaccatgtgatttgattactaaaacgttagttctcagtcctcttccctggcagaaacatctgagggagtagggacaggacggggaagggtcaactcagttcccttaattcagatactttcagcacccctctggcttctgtaaactggctcgtcctgatgccccctaaaggatcctgtctgcctaatgttttttctaggaaaacttatcttaccaatggcccttgcataatgcccctttttcctttcagtggagtaaaggctgggccacctgtaaatggttagtgcactcagggattaactttaatagtaaaaaggtcctaagcattcttaaacaagtgttcagcttacaaaaattgtacgacattacgcttacgtgacaagtgtaatacagttgtttggtttagtaaatgcctaaaggagggtcattggagatgaatttgtagcttcagtaggttctggtaccaagaccagccctcatctgtatgatggcaactgaagactttcaggatattgattaccttaagaaggaatcatttgttaattcactgaccacactaggtcccaccgacccagccttcttgaaactcctttacctcagaattttaccacgccattcttacatagtactatttattcgtgtttttttgtttgtttgtttttctagattggttttgctttaacttggtcttaagcttctggaggatataaaatgagtatagtgagtttgttttcacactactataaagaactacctgagactgggtaatttttaaagaaaataggtttaattgactcacacttcagcatgggtggggaggcctcagaaaacttagaatcatggcagaaggtaaaggggaagcagggcatgtctcacatgtggcaggagagagagcatgtgtgaatgaggtggggaggtgccacacttgaaaaccatcagatcttgtgagaaatcactatcacgagaacacaagggaaatctgcccccattatccagttaccccccaccaggcccctcctctggcgtatggggattacaattggagatgagacttgggaacacagagccaatatcagtgagtctcatcaaatacacgtgtgggggaggaaaagggaagaggggaaggaggaggatagggaccaatttaaaaagcatggtgtagcatcctgccactgccagcaaggagcatatgcccccagggaatgtctgggtctggcgtcctcagtgggcctcagtactgtacagtcatgtacatatgccacatgcactgcgctgccccgatggtgctctaaggaactgactataagcaaactttagtatctagcccctagcataatatgtgatttcccccgaattcaatacttaatacttgagtgagcctgattcccaggtgaaaacgctgatgaatgcagaggcatagattagggtattaggcagctacatcttaagaatttaagaacagtggtactcattcagcttaaaaagctgcttctgtggaatttgcatgatttctctttcatggacatactcactggtgggctacaactgttggcattaaaaatccagcaccaaaatctagatgagatgctttcatcatctaaatctcaaaacactgaatacgagataaaattacacaaataagtctttaaaactttctcagagaaaaattataacaaggatttcaaaagattctgaagggaaataaaggcaagtatgatacaaaatccgtctaatagtatataagtaaaatcccaagatatcatatctatctatgacatctctctctccatatctacatctaattttaaccaaaagaaatctccttgggaataagtctgattaatggcttctaaaaatgactgaggaaatatttcctcctgaatttccttattcagtctttactcattactctcaaaataacacaataggagcctaaagaagctaaatgacctatttcttcagagaatccatttcttaaagggaaaatgaaatattcccacttcaggtggaatcacatttatataacctgtgcattttttttgaagtgtattgagtaaagtgagcgcttttttgttttggtaagttttttttttctttttttttgtaaatggaatcattttaagtatgctgagagcttactatcttaaaggaacacttaaatcctttcataatgaaaattgagtatattaaatgtgtgtgcttgcatacacgagcgcacacacacacttaagtgactgttagttcagtgccaaaagacttacagaaacagggatttaagcatactaggcatccagaaaaggttatggggatctacaaagcgcctacttgggagaaaatgttgtgtttcttgtggtaacataagtgaatgcatagaacaaaccgttttagagcaccgccaggctattatagagggttaagtgcaggagtaaatgattcagacaaggactcctcaccctgtggccaggtagtcacaaggcggggatcctttaaaaaggtaagctctgcagcactttgagaggccgaggtgggcaatctcgaggtcaggagatccagaccatactggctaacgtggtgaaacctggtctctacttaaaaatacaaaaaaattagcggggcctagtggtaggtacctgtagtcccagctgctcaggaggctgaggcaggagaatggcgtgaacccaggaggcagagcttgcagtgagccgagatcgtgccactgcactccagcctgggtgacagagcaagactccatctcaaaaaaaaaaaaaaaaaaaaaaaaactgtgatcttgtaggtctaaggttgagtctgaggagctgtatttattataataagccccacctgttgaggatggatgctgctggtctgaagaccatactttgagtagcaaggggccagtatagacaataacagccatcggagttcaaaggagagaaatgaatatggtctggccttgagacctctctcaaacctaaccatgtcttctagtaatacgaatcctgtcttaatctgcttaggatacaccttaaacaaattaagtcatgatttcatacacaggtatatatcggatggagggtttggtttcagaccactgcaataaagcgagtcacacaaatattttggtttcctagtgcatgtaaagtcatgtttatattgtagtctactaagtgtgcaatagcattatgcctaacaacatgtagaaaacttctttattgtaaaaaaaaaaaaatgctagcaatagttgaggcttcagctaaggtctttgggaagtggttggtttctagtgagactgtactgtggaaaggcagcctgtgtagaggttataagcaccagctttagaatctgactgctagggtataaatcctgtctctaccacttatcagccatgtaatcttgggcaagttacttgacttctctgggcttcagtgtcattgatagattttttttaatccttatgccaatagcacattgtcttaatttagctttatattaaatcaagatttaatatagtgtgagtcctctaagttcattgtttttcaaggttttagttttttaaaaaacctattctaggacccttgtacttcaatataagtgtctggatcagtttgtcaatttctataaaaaagcttgttggaatttcgattaggattgcaatgaagcaatttgaggaggtttggtaccttaacaataattgagtttttcaatccataaacataatatctcttcttgtctttaatttttctatgtagtattttatagtttatttatttatttattttgtcagatggagtctcgccctgttgcccaggctggagtgcagtggcaccatctcggctcactgcaacctctgcctcccgggttcaagtgcttctcctgcctcagcctcctgagtagctgggattataggtgcgcaccaccatgcctggctaatttatttgtatctttagtagagatggggtttcaccatgtttgccaggctggtctggaactcctgaccttgtgatctgccggcctcagccccctaaagtgctgggattacaggcgtgagcgaccacacccggccattttatagtttttaatgtaaaggagctatacatctttttgttaaacttaagatcttaagtaccttatgttttttgatgctattataagtggcattaaaattgttttccaaaatattgctaccggtacctacaaattgattttcgtatatgatcttgtgtcttgcaaatattgttatactgaattctagtagggtttttattgattaggataataggattttgtaactgtagattaattaggatacacaatatcatctgtgagtagacagttttactacttattttccaatctttataccttttatttattcttgctttattgtactgctaggacctgcaggctaataatgaataaaaataaaaatccttgccttggtcttcatcataaagagaatgcattcagtatttcagcattaaatattttagcttacaggtgtttcatagttgccttttattagattgggaatttccattctattcttaatttgctgacagcatttatcatgaatggatgttggattttgttaaccagcaaatctacatctattgagatgattgtattttttttctgctttattctgctatatattctgctagatttttttgagacggagtcttgttctgtctcccaggctggagtgcagtggcaccatctcggttcactgcaacctctgcctcctgaattcaagtgattctcttgcctcagcctacctagtagctgggactacaggtgtgcaccaccatgcccagctaatttttgtatttttagtagagaaggagttttacaatgttggccaggctggtctcaaactcctgacctcaggtgatctgcctgccccagtctctcaaagtgctgggattacaggcatgagccaccacgcccagcctttattactatttttttttaagatggagcctctggtgtgtggtggcgcgatctccgttcactgcaacctctgactccctgattcaagcgattctcctgcctcagcctcctgagtagctgggattacaggtgcccaccaccacgcccagctaatttttgtatttttagtagagacaggtttcaccatgttggccaggatggtctcgatctcctgacctcgtgattcacccgccttggcctcccaaagtgctgggattaagggcgtgaaccatcgtgcccagctgtgcatggttgctttcatactagcatggcagaattttgtagttgcaacagagaccatatgaccatcaaagagtaaaacgcttactatctgaccctttatagaaggtttgctgaccccttatataatggaaaagaaattgagattggagaggtaaaattagctccaagttttcagaagcagacaaaactcattttgagtctttgctcagtttgttactagatagagctctctgacctttgctagaaattatttaaaaggaaagtgaatgtgaaaatgtccagcaaactggttggtacactttataaagagatttggggtttcggccaggtgtggtggctcacgcctgtaatctgagcaatttgagaggcttgaggcaggtggatcatgaggtcaggagattgagaccatcctggccaacatggtgaaaccccgtctctactaaaattacaaaaattagctgggtgtggtggcacacgcctgtaatcccagctactcgggaggctgaggcagaagaatcgcttgaacccaggaggtagaggttgcagtgagccgagatcacactactgcactccagcctgacatgccatgcaaccatttgatttcttattttgtttgctctggaggagttggattgaatgaggtcccttaaagggtcaaatagctcagatgtagatgttaaaggtatcccccactgttccatcagattggaaggtgatcctcaaatgacgcttgaattcaggaataaactttagccacacacacgtacatacacacatataaatatatgtatatatattttggggtacctattttcaatataaggactcttaagcatcaaacatatcctaaaataatcggtcttcagagacccctcccacacagatgcttttatttttcccaaaacaagcatgaattgacttagaggctggctcaaagatataacggcaccctccagcatggtgaatgcactcaagagggcattgtcccttaccacagcttccattccttgcacctggctccaacccctaggacatcagatacttggatgggtagatggatgaaccaccattctggatagtaattttcgtggttcccaagcagcttttttactctcagtggatgaaaaccaatacgggggaagagaagggaggcagaggtgttacttacctctgtataatagacatgtaggatcctcaactccagcccaggtagactcttattggggattaaatttgatctaacatgtgacgtctctggaacaggagctggtaaatggcagactccaatttcattaggggtcaaggagctagaataaagttacccttcatgttatctgtttccttgaattttcttagccctggacattaaattctgttctttaaaagtcgctcattgaggccgggtgcagtggctcacctctgtaatcccagcattttgggaggctgaggcgggctgatcatgaggtcaggagattgagaccatcctggctaatacagtgaaaccccgtctctactaaaaatacaaaaaatcagccgggcatggtggtgggcgcctgtagtcccagatcctcgggaggctggggcaggagagtgaatccgggaggtggagcttgcagtgagccgagatctcaccactgcattccagcctgggctacagagcgagactctgtctcaaaagaaaaaaaaaaaaaaaggtttctcattggaattgaaaatttcttcctatgacgtgtctgagaatatgaagtaatgaaaagtgggctgggtcagccttggcctgaagtgatgcttacatgaattaaccatctctggagggatactcgtgtcaaagtaggagtttattcatgcttgactctccagtgtgatgtctgggattgcttgcgccagctctgaggagggcgtgcttgtctttctttgtgaaataatagaatatggatgaatccgtttccccatgaaaccatttctgttgaactaaaatacaaaggaaaatcggtgaccttgaattaggcttgtttgcagtgttattagctttcaaaggccctttcatttccatttaatgattttcttctgaacaaactattgtaagaacctaatgcaatttttcaaaaccaacatcacaaacgtggttattattttgtagctaatttggttagaaaactatgaggccctatgtattaaaacgtcatgccatcacttctcagaatggcacttttaaaaactggattttagtcttctggataacgatttcttgaactactgttatcaagaataagtggtatttttcatgatctttcttgtctggagagttcgtgacaggaattttgtgcatgaaggatgcctgtgttgttgaatgtgttcttgcatccatcttgctcttactcagatgtctgaagctatacatgtcaacttactcattcaacatgtatttataaaagtgtccattataggctaggcacggtgctgttctgggggtcatcaatggaaaaaacagactataaaatccctgccctcctgtagctaacattcttttaaaatactgatggcagaattttaaaacactgatggcagaattggaaagaatgcccccgatacaagcaagaatgaaatacagtttttattttctgcatctaaaaatcacaataagtaacttacctcgtacttctaagagtttgaatttttttaacttggtaataattttagtaggcagggtgcagtgactcacgcctctaagcccagcactttgggaggctgaggcgggcagatcgcttgagcccaggagtttgagacaagcctggtcaacatggtcaaaccccatctctacaaaaaaataaaaaaattagccagacatagtggcatgtgcctatggtcccagctactcgagaggctgagatgggaggatcactgagccctgggaaggtcgaggctgtcatcatgccactgcacttcagcctgggcaacagagtgagaccctgtctcatactactactactactactactactactactactactactactactactgctactactactactaccaataataataataatttagttgctctgataaaaggccatgttactttacttatggctactatttgagtgcccactgtgtctcacaccctgtgctgagcgttcccatttaccccatttggcagatgaaaactacagcatgttctcaactcagtagagagacacactcttacacatggaatcttaaaaaggttttaattagtcacttacaccaagttctgtgatagttccacagtgactgaatccaaactgcgcagaattgagagtagtgggcaagagtcaacgatgggtttccagttctgggaacttgggagactggggtgaaacaggtcccctctttcctgcccacttactcctccaaacaccaacttgctggatgaaatattacatatgatcctcattgaaagagaaaaaacttggaaagagaacagaagggagaggaaaaagatgaaactgaaggggaagggagttgttcttaaccacaagagcaaaacaaaagccagagctccgtgtgagctgccatagtgtggtgtctgtagtttctgtatggccaggaagtgcccttggaagcaagtttcatgaacataaatgatcaaagccaactaaactggtcaattagtcaaacttggcttccttagaaaagaataggacctcaatttagccctatttgtcagctagaggagtcaatgcaattgaggggtaaggggttgacagtggtaataaatcattgggcttttttctcggctgtatctttgcctcataccttcgtcaagccaccctagaccctcctctagcagctccaagccccttttgtttgttgtcacttctatttaagcctttgccttaggtaccaattagtgaagtgattatcttaaagttgccattgtcaatgctttggagaacgccttgcattttgaccaagctggtgagggaattgttaagttaaagatgaactctgcatgattaaggtatcaaaacggcttgaagactgccattttaatgcacctttcacaaggctgtgcaactctatacttaaataagtggccagttttgtttttaagtgacgagccacatggagaaaatacttccaggatttcagttttgaaacaattgaaattctcctcctcttagagtgttagctcctgtgtgtgtgaaatacagctggtcacctctccctgtggtgctgactctccactcacggaccgggcaccatctgagatgtttgacagaacattctgaggaaatggaaatgatgaaatcacattgaattcaacagtagaatgataggccatttaatgcagccttaatcttgtggctcagttggtgtggtgtaatattaggcttgcattctaccttccaaatcccttgatagtataaactagcaaattaagacttaccctgaaaatgactgtgtgctacactacaagaaaggtagaatgctccaggagcagtacagatagaggtagtaacattttgccatctggcaaagccactagaccagatggattcattaatgacttctctaaagtatttaatcagacattactgaaacacatgactggcatatttaattatcctaaattaacaggacttctgccagatacaaccctcaatgcttgagtcatactccttgcttaaagagaggaggaaaaaaggatgactagctccagaaagctggatttcacatagacctctctcattagtgaaacttctcattagcaaattgttgtgttacagtcttaggcagtatttcttctttttcaaagaatgcactgtaagactagccatgctgatcaaattcttttatcagtagcaattatactggtgagaacctctgcgagttgataaatgtgacatagccatcagacaaccctgcccacttcctgcctgtggaagacttctaaaccaacagatgccttcttgtgtcagttaatcaatttatatttctccaggatcacttttgttttaatctttgtatttgtatcagaacaatggagacacaaaataacagaaagcattataatgtaaatttgcccctgctctagtctttcctatctgcaatctacttttcaaaggaacacttctaattttcaggactgttctctctggtggttacttccacatctcaaaacagtatggttaatggctatttcttattttctttagacatgttgacttccttttaacatacatgaggatgtagcttaggtataccattcttacatcacttttcttctcctccctgagggttattttattttttattcccttaacgtttacctttgtagctttaggttatattttcatacctttttatttttgggattgtcaactagaaacagtatgtcttggctcctaacatatgttgaaggtattagtgacttgagtattccactgaatgctccagagttctttcactcaatgtaatatttttgagattcatccatgctgtggatgtcactagttccatttctgtttatggctgagaacaattccattgcatgaatagatgataatctatccattcacttgttgtacgtgtgacctatttccgatttctggctcttttaaatctgtgaagacttgtatgcaagtctttgtttagacatttccttttggtttcccttggataaattctgaagagtggaattgctagatcataatggtacgcatatgtttataagcaactgccaaaagacttttcaaagtgatttatcattttacatttcctattagcaatatatatgcattccagttgccctgtgtctttagcaacacttggtattatcagtctttttaattttagttgtccttaacattgttcaagtcttccagcatattttaaattaagttgtgttcttattaaattataagcatttttatatattctgggtagaactttggtgattttgttgtttttttcttttcattctcctagtctgtgttttgcattttcattttcctaatagtgtctatcaaagaccagaagtttttatttttaaagtccaatttctcctttgtgtaatggttcatgcttgtttgttctctaagagaccattatctttcagaggtcacaaagattttcttatatttttttctatcaattacttggtttagctcttatactttttgagtttttttgcatatggtaaaagggaagagtaaggttcacttttttccatatggatacctagttgttccagcactgtctgttgaaaaacaatcctttcccctgatgagttatcttaacacttttgctggaaatgagttgatcatataaatgtgggtctctctatggattcaattctataccattgatttgtatgtctatccttatagcaatattctgtcttaattccttttaataaagactttaagcagaacttctacttttgttaacattttttctgacatatacatgtatgtatatacatatatatgtgtgtatgtatatatacatgtatgtatatatgtctatattttagatcttttctccttagggaggcatcttcagataactgatcttgtccattccaaatggtttttaccagtttaaatcacagagaatagtcttatttttaaattcaaggagagttcaccatagctctctatgtacatgagttgctcggacttagaatgtctgttcctggccgggcgcggtggctcacacttgtaatcccagcattttgggaggctgaggtcggtggatcacctgaggtcagatattcgagaccagcctggccaacagggcgaaaccctgtctctactaaaaatatagaaaatagctgggcgtggtagcacgtgcctgtaatcccaactactcgggatgctgaggcaggagaatcgcttgaacctgggaggcggaggttgcagtgagctgagatcacgcccttgcactccagcctgggcaacaagagtgactccgtctccaaaaaaaaaaaaaaaaaaaaaaaaaaaaaaaagaatgtccgtttctgggggtgaggggtaggtttcatgtgggtctatcacatggtggttaattaataacaataccacctatatagtgctaggttttaagtgctactgttttaatcactgctttaggatttattaagtactcatagtacctactttctttgaggtaggtactgttgttattcccattcttatggatgagaaactggggcacagagaggttgagtaatttgctgaaggtgatatatgagaaactgttctttgccagtaagtagaggagacaggtttcagtgatgcacttgtcacggaacaaacagctctccaggagaaaaaaaactatgcatacgcattaataaacttatacactttactgacataaataatatataatgcacaacttacaaataataaagtgtcatactttttattccacatggccaatcaattctgatagaatgcttttattgattttttttttcctctttttctaaactcctatatctgtggtcagtctatggttgcagtttaagcatgacttgacaaaatcaaatgaggaataaattcttgattaccatctggttcagcaaagaagttgttcacatcattggcaaatgattaaagttccaatatgtatatgttttacattttccttattaatgtaaataaagctatcagccaacatttgtgttggaactacacttgttggtcagtgatgtgagagaatattgaggacgttttctcaattttatatattcacaatgtaacagctacagagtgacacgcttttatgtttattctgcattatcaacattttatcctatctcttaagtctagacaatcaacaaaacaataaattaagccctgatttgtagcacttagtgatttccatgatgtaaatatacccactatggctgacttcaagccaccaatgtgacatcattgaaaatggagttgggaagaggtgtggagtaacacaccatctatggtatttctaccatatggataggatagcaataaataacctcacaactatagacaacagtgaaatgtagtaaaataattaccaagtgacgagctttcagtatgtattacctttgcttttaatataatttatgtaattgtaaatcaatataatacctaacagtggctgtgattaactggtttacaaagttgctaaaacttaatcagtttttggtggccagtctaagctggctccaatcatgccactgtatggctgtatttttaaccattcttttatacgaaggtattgctggaatatagtttcataccagtaagtatagcatacagttatggcaaggtattaagtttattttactaaatcacattctcattagatgcaccactcatcaagcttgttaaagtccagttttagggaccccccctgcttaactatggattatacgggttctgtggggttcacacaattcaggaaaatggcaatgaattttgctgttttgtccatgttgctgtcattcctgtttgtgctgcccaagcccaccaggaaggcagggccctctctgtggtgtcaagatcacagttgtggtggggtactgaagtgctaagcgcatctcttgggaccaggactggaacacagccatccccatctgaggttccactacctccaggccactgttcaaatcaggcctgcctttgccttttctgccttgcagatgaacatccactgaggttgggtcactcccccttcaatccccaaagcagcaacctccccttctgtcgtcagacaatgcaacctaattttgatgtgcctctgcctctgacatggaaaagctgctctcaaggttatcttcagggcagggagggagaaggctttcatgctttcctggtgagactttttttttttccaaaaacaaaacaaaaacaaaaaaaactaaacatataaattattactgagagaatcactgaagcagcctgggcaaaaatgaaatgaggcttaagaattgtgaacattttttaaatgctgcacttggaacaagtgctcataaaattttttgcctcaaggaatcaagaatgattaatattgatgagtgttttgttgttgttgttaaacttcataagcaaggctgtttccttccatgacccttttgattctcatcttttctttttcacaagatgtttggaaatcttcgtgatcttatctgacatcaggaagacatgcttttccctcctggcatgctagagaaacaaatcaatttcttctcccagataggttgatgaaagtccttctctgcagtgctttctattgctatggtaacagaagatgggatttcccaacagaactaggtttatatattaaaaaacagttctttcaaaacttgatcctttttttgttgccatatataaaatacaataaatggaataaactgagtaccaaaggaaaaacagtcacaccaaaactttttatgtaggtgtggaatgagactttcattgtcttgagactcgcaatgaaagggagtcaactgtaaaagttttaatattgtgacagtgctgtcgtagctaaaataacttgcaaaagttgcaagtcttcttagaaaagcaaagaattaaatatatggactctcaataggcagatagacttaaaatagagataagtagtgtccatacttccagtcataacatggtaaagaagatgacaagaagcccaaggtagaataagcattttgtgtgatggtggcactctccgcttctgtgacttgcgctatgggaggacacaatagttggccatttctcatgagatcttatcaaaagcccagggattcaggggacagggttctttgcatcacagtccctcaattatatgcaaagacctgaccttttaatctgctggttgactaacagcatggctggagggtgacttctgaggctcagagcactcagaaaggagcagagagcaattgtgaggtaggtagaaaaggatggacttggtttcatttggggaaaattcaaacataatacttccctgtcatttaaaatgcttctgaactaaaattccaaagatgtgtggaattttatttattaaataaatacttattaaataaatctgtaactccaccattattgataccttctattctcttgcaaatctagtgagtaaagttcgtgagcttttctccttttttgaggcttaacgtgcttttgaaatgacatgacaaatttaaaatagaagtaaatgccatttggctgtgccctggatgagacatggatgccatttggctgtgccctggatgatacatgtcactgctgaaaggggtggagtttctgggaagcctgatgggaaaggtaacaaatagtaaagtgaataaaggtggttctctgttcttgctattcttgacatggacatagataaatggtaacattatgagtcactctaagcaatcatgttacatcaagccagagaggtgatgtcacagactctggctcatgaaaggagaaaaagctcattttcttaatgtacccaaatggcaaaggaggactggagaaagggctgtaaagagatgatttaacaaacagtgtgaaggaacttctggcaagaaaaaaaaattgcaatgtgaactttttagtaaatgtggtaaatttatgggcttcaatatgaatgagaagaacaataaccagcataaaaatactttaaatccaaaatgtgaggtgttttggggtagcactgcttattgagtaactaaggctcgtaagttatttgaagacttgttgaaatctgtttattccattccccccaaccccgtcattcaaagaactgcaataaatcaggaattatggaattagaacaactgctcggagcagtgatttattatttgcttctggatgcttcagaatctcaagaatctaacaagtatctcaaggattttaaaatagaagctgtgatcacagcaaaatagtataatttatatctcttgaaagtgtttctggccttccaggggaaatatgctcattcttcattttctagtccctgggtagaacctcttgcctattgcagggggagaggcaatatggcagccaagatggttggcagcattcactccctcttcaagtattttgttaatgcctactctgctgtatgatgttccaggaactgtttagagtgatggaagacagcccctgccctcacggagcatacaatctagtcaatcctcttcttcctagcctttaggactccagatgtgatgctaacctgagcagtctccttggtttccccactaaaaattggatagttaggccatcttttcccaggatcaggctcataggcttcaaactttactgtagccaggctctgtgagttacaaaccttgttgcccgcacaaaatcttctgtcaactttaatgtgcccaagcttgtccttgagtctcaaacatactaagcatttccccctctgttctcacccccagtagctcttgactcttctttatcccctctacccatgtcttccctccctgtctctccctggtccctaactgaccaccttgcctctcctaacacccctcacagatctgtccttacccctgcatttcatcactgctaggattaccttcctaaattatggaactgtttatgctgtgtcctgctgaaaatagtcagtggtaccctaatttcctggcctggctaaggcagctttcaagagctgcccctgcctgcctgacccatctcattttctgccattctctgtaagactgaaactgtggaggacattgtcttttcacgtgaatcccctttgcaccttgtctttcatatgaactcgtgtcttccctaatgtcctgggcagctggtcactccatcctccatctttctccatcctccatctttctgtgttactgtgtatgtatattgacatatcgtgattatttctttacatgtctctttcctctgaaagtgggctccttcaaagatagcagtgtgatttctgtttatatgtctatggtactgtccctgacatatcataggtccacaagggcctgttgaataagtgaatgagctaaaatatactggtttatcaacagggttttcaaactgcttccatccactcagcttaatgagcaaacatggcatgccataatcttgcagttttctgggacatctaggtactttgaaataccaggtgtgtctcaacaaaattgagattgggagggtcctttcttattgataatctctcaccaactgaatgctgaagtgttctacaaccttaaaaagttaaaagcttatagcattcacctgttgtgaaaagcaacccttctatatgggctatctttttgtattacttgcttatgaagattcctgaagatatattttccagcaagcacttttcagatgtccaacatggatttaaagtacatatgttgtttttggaagccatattatattcacacaggcatgtttatgttggttatagatatataatgctgattacacaaaagacaaaatttgtattcagtgttcgctctgtaccgggcactctgctaagtactctagattgactatatcatctattttctgtattatctgtatttttagatgaggaaactgaggcaaaagatgaagtaatttgtccaaagaaccagagatactaagggcagccaacatgcaaatccagtgtctgatatcagaacatatactctcattaacaccatgccaaacactgaaaaaaaaaaaaagtctacttccatttactgtgttaagcagatactgaaaattggaatgggaaaatttgtatttgttgattgtataagcagaagtttacacaatgagctagtttgctatataggtaatgtgctcttgattcccaacgtctgttttttagaaagacacaacgcctatacacaatgaatttaaaacattagggtgattttttttttttaatctaggaaaaatacttctcaacggctactgactccttaaaataccagttggtatttgacgaagtttcatttttatcgaactacagagaaaaattgctatacaaaccacaattgtaatttgtagttctttggtgtcacagtgatctatgtaaaatggaaactttaacttaaaatttgtaatctatagcaacagacacagaaacagcacatgactctgggacccattcatgctttgaaatcctaatgaggatagtatctagtgcttctgcaagtatgtttaattccaagaagagaaccttcccctagtaacaacatttaaaaaaaaattaaagtcaaaagctaacttgaaaacaagtaatattttgaatatcaataattaaatttcacaacataaagcaattataaaactatacagacgattttaaattgaataattacaatcacaacagcacctaattttcaaggtaaccaatgggtaagaccaaatgagattgtcagactgtgctaagcctctctgctaaagtgaacatttcaattagtcaaatcaagtaattaattactttggggacagttcagactctttctcttgagatcaccttgttagataatttaaatgagaaacagatttggataaaaggtgatcagtgttttcttcagttggaagatgtgaaaagaaaccttttctctttcagccttgccttacacccagacaaaactctcgttgcaactggccaagtcgggaaggagccatatatatgcatatgggattcctataatgtccagactgtgtctcttcttaaagatgtccatacacatggagttgcctgcctggcttttgactcagatggacaggtgtgtatctttttttagttgttttatttaatgacttctcacaactcacttaaaactataataggaatagccagtagattcaaagtccatcaacccttgctggttcttctggcacagcctcctagaatttttcacctgttttttcccctttaaagctatggcactaacaccaaactctggacaggccttggtttttgttcccctagtcccaccatctggttaaaaagcatccataaaagaagtcatgaattcatggtgatcaggttcaccatagcccagtaattctactttgttgtctgttgttagcttcctatttggagtaagggctagaccaagccttattcatagacgtcaagccctgagcatgtctgtagtacctcttgctttcaaaagatgacatcacctcctaataatccactgagaagattatccttgactctttaccccttgatgtcacttttagctgcttctacctgtcctctcccaattcagtctatcatcaattcctgggtattcatgtttctttacagtaactgacatcctctcctttccattcttcctgccactgtcctttaagtgctaataagtcagtgtcatgtctgacttagttgaatctcttagtctcctcacaggcaatttcttgctaatgcatttcatcaactgaaaacggtgtgaaagcattgtttaaaaccaataagagcttggagtactcaatgaataaagtccacactttgtaggtgggcattctattttagccaacttttctagacttttatccgttgtgccctcatagtcgaattggacaaatctgcaagactcctatagcagaccttgcatgtttgtacctctgggccctgcctcagtctgtcctgtccacctgaagtgtcctgctcacccttttgcccattgaagtgattcagtctccaaaggttttcacaaagccttgccaatccctcccaacaacattttctcttcttcctttgacttacagcaacactgggcagaaaagataggttgatacgttctagaaaagaaagtaaaaacggaggggtcattcctggctccggctgcattcatctcctccctaaggcggggcctcttctcctcatctccccaaccgcctccgtttcctgtgccacccttcctctgtctctctcaccctgcgtgtttctgcctgttaattccttcaatctaatttttgacaagtttcagagttaattctgtaagttggtgccatgcaaagatctgtgaaattattcatagaggcttaactgaaagtctgtgggaaattcagtggattataggagttgacctgggttgagtcacttttgaaaaacaattagcatttacttgctgttttctgctattttaagagagcatcgatcactagtcatttttctttctagaactagatttattacatatgtagacccctggaatatatgttctttattttactcctttgtaatctcatccagttagtcagtttaatgcatgcattcccttttatggctacataaagagataatagctggatgctagtatttgttcaggcttgcagttatattgacttcctgaataaactgaagtgaatcagaatccatacacatgtacaagtataaatgtatgcttatgtctgtactggtatgcaccttctctaatcggattttgttattcaagcaagcattctttatcaatttgttctgaagtgtcacaagaaaatgtaatgcagcagaggaaaatccagctttaaaaatccagctttaacttcatttttgtccatgttaatttatgttagaatcctagctattctcctttaggtttcattttgaaggatggtgggtgggggtggattgcatggtacttaactgtcaggtgagagaaataacctcttgtatgttagccatggtggatttcctggcttgttgatggctatttcttcaggtcctccttactccctggacagagttcactggaatcgaatgatatttagaaatgacaaatggtccatcacctcacaatagacaaaaggcaataaaaatgcttttcaggtagctatgggaactgtcactacagatgaacaaaataggtttctttcagctttttctccatcaggaaatgtgggttttacttcagtgcccctatttgtgttcactgctttttttctcttgaataagctgaatggaattcacccattcagattttcttatgaataaaaatacaaccacatcttgtttccattgctgaaaccctcagttaaaaaattatagcaaagaaatttcttaaggacacattaaaaaaccctcaacgatgtgtgttatattaaaaattcctaatggaagccatctttagtgaagaaagctgaagaatccctgcataacagcacatgtatacatttaaccatatgtggctgtctgtttcatccacactgtgagtgtgcatatacacagacacactctcgaatgtactcagtactcacacactcttacacttggggaataccatatttttaaaacccctttaatttacatacttcacttgacccatacaacaatccaataatgcagaaggaatgattattttttatacccattgtacaaatgagaaaagtgagatttaaggaggttaattttgcaaggtgttatgtctggctacttaaaagcaaaaagaaaagccaaatctacttatagttcagatttcttacataatactttctccttataagtgatatcctgcaagaaactctgattttggtatgactgttgcctgtttttcacacttttggttttgtatataatcatgtgggttgcattttattcttactttaaggacaggttctgacctgaacccagggaatttaggctgggaggtgaagtaccagattacttctacttagattatattatcttgtagtcaccttaaatgtttgtgaaattatagaaaactaaaaattaatgttcatttattctattcgtcaaacccttaaattttagcagttggaagcttttagactatagaattctgggttctattaaatctcacattaagattttacctaaaaattttaagttaaaaattccaaatgctgctatcaagttctgtttctgtagtttctattgacgtttcagagatctcctgagagtttatatgtatgtttcttacacttaaaaaggataaaggagctgtagctcttaggttcttgaaatttcagcatatactaatggaagtcatcatctattgtgttatttttagtttggggtttaagatgggttttgagaaatcggtttgttataagaaattcaatgcctaacccatagtaaatagtaactatttcttaacgtgtcagtaagtcttcccatcacttttaggtactaaattattgttcttattcttagcgtttagcctctgtggggttggatgccaaaaacacagtctgcatttgggactggaggaagggaaaacttctggcgtcagccaccggccattctgacagggtaagaacttgttggatcaagctatgcagatttcagaacttggggggacttgtgatatcgcgtctcagacttctaatgtttttaacagtaaatatttcagtatacattttttcctattaaacttataatcatcctcttttttcatgattaatagctaactgtgttaatgtgcttctggtgatcaagtactttatatgaattgttagtgcttttcataggcaaagcaaatttttgatgctggcattttactttatgaaatcaaaatggaattgaatttgaaattatgtgtagtttagatgtattcatttagaaatggaaatagttgttagaaaatagtcacaaaatatgattacaagggtatgcattttaattttgaatgagtgtaatgacaacttcgtgattctttgttgtatttgagaacatagaatgtgacctgcttactcctgttgaagtcagtgtgatcaaaaatgataattccatgtagtcttaggggatgaagggggtatatacatataactggtcagaaatctaatttgccagtgtcttgcataattaaaataatttgactcctttattatcttggtttctctaaacaatgaatttgcatgactgtcttacttgaattcctagttgttttgtatttctgcacaatataagtgttaatgtagaataggcatttccagtcttttggcttccctgggccacattggaagaattgtcttgggccacacataaacaccaacactaatgatagctgatgagctaaaaataaaataatctcataatatcttaagaacgtttacaaatttgtgttgggccgcattcacagccatcctgggctgtgggttggacaagcttcatgtagaatgaggctctaattaaacatgaaattcactgtctcttgcttagaaggaactcttaaaaaaaaaaaagtatgaatggcacattgatctatggaggtttgtagttgtaaggagaccccacagatgttgcaaattctactccaggatcaagtcttcagaaagctcaggagtgaccaacaatagaacctcagtactggaagaggcctggtacccctctcgtccagtagttcccaatcctggctacagatagaatcctctggggagacttcacggcatatatatacactcatacataatattttatctgagttactctgcatttactgcttctatttctgagtcattttatatagtctgacctgaactagtatactgtctgtcagaattttgggccttatcaccttggaaaaagtagaaaactaaagttacaaacagtttaaaccagtaaaatctccttacttagaaaaatagcctaatgtaatcactttggcttgtatagaaagagcttttattgttaaattattactgttaaactaaatttggcctcagctgccctccatatggtaagtctctacaaaatcaactgcaacctagcttgctaagtgaccaaactgaaaatttaggggtatacttccgtaacaaatagctgagtggcagccagcttcagccaatggcaggctgccatctattcagaccatgcccaaataaagcaaattcggtgctgaaactaggaaagctgttcctgtacctcagttcattttccccaggatacatatgcctgcccagttgcagagcagagctctctgaacctcttctggttctgagggctgcccaatttgcaaacagttgtttgctcaattcaactctgttaaaactttagataaattgaacacctctggatatcatgtgacttgcctgtatgtttcagtgactgtgcatgtgctattgctgtgctaccgcttgccagtaagggtgaaatgtaaaaagtataataggactatagtgatgagtctgtaatcttaggatgttttaatgaaatgctttatttggaacactgttctcccagaccccataatctgtgtcacacataattttgctctttattactgataccagtatgaattattgactgcttatgattaacttcaagattatcctcaagattattttagtggcactaaaatacttaatccattacatttatataatgaatgttttataccctgcaaaatgactttatataccttatcttcattgaccttaacaaaacttgaggtggtattatccacgtagagaagatgaggttaaggttagagatgctcagacttgcctgagcttgaatggctgaaatggatacttggaccaagtactttttcttcagtgatctttctggggaccataattgctcctttatatgtgatgaaaagttagtggtctaggttatttctctggtctagactttgtccctgacaagtagtccttccctttctatcagtgtgtcatggaatgcgttccatggatctacctccatcagaatctcctggagtctctttaaagtgttgggtatctgggcccaattccagacccactaaatgagagcatctcagatgggccctggaaatacctgttttaagcaattgctatgggcaatttgattctcaggattgaccttttccttcttgtctctggattggaaatagaactacgtgcaaactgtctggtagctcttgttaaagaatgacaaataggccgggcacggtggctcatgcctgtaatcccagcactttgagaggccaaggcaggtggatcacgaggtcacaagattgagaccagcctgaccaacatggtgaaaccccgtctctactaaaaatagaaaaattaactgggcgtggtggcacgcgcctgtagtcccagctactcgggaggctgaggcaggagaattgcttgaacctgggaagcggagttgcagtgagccgagatcacgccactgcactccagcctggtgacggagcgagactgtctcagaaaaaaaaaaaaaaaaagacaaatagtagttgcagatatattttcagttcattggataattgaaaatacaatagtatgttgggtcagattaaaatgatagcctgagggactatttaagttagtgacagataaatccctctgccttacgtttaggaatattaacttctgtgattactagagactgttggccgcattaaattgtagttaactattgaatgttttcctagctaagaagcattttataattctttaaatttctattgaaaagctatctccaaagtgttagcactgtggagtgctattgaaaaatttgatcaaaaatttatcctaaattgtccatttgtttatctcaaatggacaaaattaaaaatatgacaccagtttgttctaaataattatggtaagttctctctctactcaggccttaaggtaagtagatatgaggtgataacgtgtgtgttagttcctgactcattccaagccaaatcttccatttttattctgtgcaggtaacattgtgttctaaatgttatagtagagtcttggcaattggactagtattgggaaaaggcaaaaatataccaaatgatcaacatggcaacttttaatgttttgaacagatttttgatatttcctgggatccatatcagccaaacagagtggttagctgtggagtaaaacacataaaggtaaagctttttgttttttaattttggtaccttgagtgcaaataattttaggtgtttgtatagataatttgatgttgagagactgctagactttacattttttttcttcaatatagagccctcttacctgtttctctgctcctgaagcaaactaacatcagctgatggggctctctcttagaaatgcaaagtaatgacaatcaagtgaagtgctccgcaggcagctgaaaaggaaattttatgttaattaaatatcgaactgaagactcataatacttgtgggattgcatgttttaaaacagtgcttattttaatgttgtgaagtaagtttttccattataatgaatatttacatatttgcatgtcaacactttgacatgttatgttcccttaaaagaaaggtgtcaagttgtgctctacatggaaatagaggaattcacagtacaaacctatctggaccattggtttttaaacgccccaatcttcctctagactacactctcatctgggtagacctacatttgcttcttactattttgttcacaagtaacaaaattaactgcatcaacatgctttgctctgacatagcaaaaatttctcctgacccctgggatatagcccaggatcttctttctctataggatcgtaaataatgtaagttaaagtccataaacaagagtataaggattactttcttgaatagagcatgcatggattctgtacaaaaatggtacatttctgtatgaatgaagattttcctctaaccaacccctcctattttgcagttcttttagtctagtttttcacgatccttcccattagtcttacttggttagaaggggacagaggataaaatactcaaataagtataagaaatatggaagacttacctaaagaatgttacaaaactctgcagaagaatgtaaaacaatacttgaacaaatggagtgacaatgttgattctggacacgtctaaaatttacaaatgtatcatttatctccaaatttatatttggtagaaatgcagttaaaatccctattacttttgtttttacctgacagaatttccctttaaattatcctaaattaatccggaagcattaaataatgacaataactatgaactttgggataaagaatcatgaagaggatatatgtaccactatttactaaagcataatagaatttaatttaaatgatacaagacttggatacaaagaaataaaaaaagctgaaaaatagaccttaatatgtatgacaacttagagtataatagcatctctaactggcaggcacaaatttatcaattttttagaaaaagtcaatacttcatactatacactaaaacaaagtctatatgaattaaagaggtaagtttcaaaaactataaaataactagaggaatatataggcaaatatttaactgctcaaattggagaaagatttttttaaaatgtaaaagcaaagaaatcgtaaggaataatactgatgcaactgtagaaatattaaaatattctgtataattccttttttccacaaaaagagggaaaccgcaaactagcaaaagtataagcaacacacaaaatagatactgggttgttctcaaaatgcaaagatctcttgcaaatccgtagaatggacaaagaacatagaaaactgacaaatagaaacactgttggccaatagacttatgaaaatgttaaaatctaattaaggaacacaaattttaaaataacagcattttaaatctatcaaatttatgattgaaagtaccgtatcttggcaaggattcagtgaatgaccactctcaaaccttgctggtagagaggggtaagctgataatggtctttcagccaagaaatttggaaatatttatccttagaaatgtcaattctctttgatccagtaatttcatatcttagaatctatcccaagcaaattgttagaagtatgaaccaagagctgactcattgctgagtaacttatcaatagcaaataaccaaatagaagatctgaaataaaccaaacagaagatctgaaaccacttaagtgtctctaggaagttgaataaaatgttacatccatatgatgaaacactgtacaatcataagttatgttttaaatgatgatattgggaaatattcaaaatctattatatggggaagtttacagtttactttgggggttgggttatggtgggattagatttgtggcttttttttctttaaaaacatttttatgtgggaaatacattagaaggacttctccaaatgttaagcagttatctctgggtaatgggttgatggataattttatcccttgtatacttcattgtaaaattattttacaacaatatatattccaaaataagaaaaaatttaaaaatggagaacaaaaattttagaggttccactactcaaaagtgtaacatattccatcaacactttagggcttcataaacatttaataatcctgtaccaagccctgatgtgtatatttttaatctaggaaaacatcagctgaaatctaggtagtttgctttattagcagcagctggaggctccttctgtgcttggtacagcatacctgaaagaccaaaaactcattcagtttaatatttgagtttgtactaggtgaaagaagaaaaacagacgccactttcaatttgcttgaagtttagccattaaaacattaagacagaatgttttggaagaaaggtaaaaatcaaagccctctatcgataaagatgacatcccagctggctagaagcatgttgtcaggatggagatgctgcttaggctgagcctcagtgggtgggtgagtttggtaggaagggtcgggaggcagaactaggcgaggggttgcacttctgtcaggagttaagagaggcattggtcacccatggaagtgtgagactggggagctgggtgggtccttggctcatgatatgttccaagattaccaatgttttcatcaccaaagaacctattccatagttttttttagggaacaaatattttgaaagatggcggccacaaaataaactagccaataaatcacgggttccttagcaatgttttattagtcaaagatgttatctgccaacgtgagtttctgatcagactaaaatatgaaaattgtttcagccatgagtaaaaaaaacatgtgagttcataatgatcctgatttctgttaggctgtggtgggtttctggaaatctgggaccctatcctgggagccatcatccatcctgtactcagtggtgaagaaacccaggaccctagggggttaggtgggaatctgactttgatttgtgattgtttccctctgcttgactctgggcaaccatttaatctccctgaggctgaattaatattcattcattcattctctctctctctctctctctctctctttctgtctctctctctctctctcagagagagatcactacctcctaaattaaagataattacattaaagagtatggaacccagtaggggcacaataatgttaatttcgttccccatttcctagggtcacaaaaatgatggcacaggtgagatttaagctcagcctctgactcctatagagctctttacactgagaaatttctttagtgaactaccttgccttaactttttattgggttctaactagatttgctgcttaattgatagaattctcctgattccttcctatctctttctgtccttggttaactctaacttttaaatcggtaaattctaaaagcagaaaagcagagacaaaattctgaaactttatttgaaacaagagctacttatcctgtttaaatttaattgtcttagcagacttggacattttttctaagcaaatacaagcatttttacctcaaagaatctggaatgtctacccagcaatactttattaattttgcttagaaatataatacatttaagcggacttcaaaaaattatttttgctgtctgtattctctatatccaattaccaggatttctccacttttttttccccagaaaacctaccttaacattgaatgattccagtcataaattgagtgcaaaatctttgtactcaaagaaaatactttcatctgaaatttgtatagctagggtgaaatcctttttggctttgtaaatcccctatgttttggcaaataggaaaattgcaattatctgaaacgaatgcttgaaaaacagtaacagttgagcatcggctgcttcactggttttatagcaaatgagcctaccgggtttgtggatactgttgagccgtctctagtcagagacagaagggacttcagggactacctagggctagatgaactcaaggtacctgccagctctaacaaaatttgcattacagtctgtgggtagagactgcagaagataaacaaggtctcctcatttgatgtgaatttaatgatgtgttgctaccctaaactgccactgttttccaagtaggaaatgcttctcaaaaagagataatatttcaggtatttgccattttctgcagaaaataacatacattttagggaatcatttgactctttggaatgttttcatgtgggccttataccatctgacctggtgacttgtcaataaacttttatgtagatcaagtctgaagataatgggttctattttttgtgactgtctgtctggaaatattcagataactcagacggggggtgtatatccaaagttaaaggacaaaataattattttaatcttcatgcatgaggaggtgtaaagagaaagggaactgtctgccttaagcattgctatgaacagcaagttctttggcatgttggtgcaaccagtaatcatttatgtctaatagtttgttcaggttcatagtaacagcttaaatgttttccaaagcttatacctaactagctttttcctagatctctttattctttattaaaaaaaactttattacaggtgtgtgctaccactccaggctaattatttttgtagagatggggttttgccatgttgcccaggatggtctctaactcctgggctcaagtgatctctctgccttggcttcccaaagtgctggtattacaggcatgagccactgcacctggctgctttattatttcaacatatacttcaacaccttttcattaataatacccaaagaaatgagttaccagagctgatacctttttctgagaagagaatccgatttggtccttcattgtgtatctgcccttcattcttgccaaggcatccctctattccttaaccccctgccacgcacacacataggacagccccccacccccagctgcctgaatcctggccaccttgggggtatagccatcccagaactgtttcctctagtacccaactactctgagaggaccatggtttttcctctcctacaggtgtaaaatagtacaatgttactgatttactcccacatgcctgccatgtggcttcatctcatcctgcttctctgaatccagatgcagtttcttcctcactgctgatccaagtcctactcttgttcattctgtttaattcaacttagttctctacctttgaatttcctgccacccgggcacagtctgaatatgctaccttaaaattatctcattgtttcatttgcctctgcattgattcagagttgtcaaagcaaagacaaagatttcagtattttttctaaccccattgaacccttatcttcagtgagctacttctgtttgctttccctcccctccagatggagatgaccatcctgtctaccttagcctattaaaggttttgataggatcaaataacttagcatatgcaaatagcccttataacctgagggggggctatatcaagggcagtgaggttattctagttgatacatgaaaactatgttaaggttttgagaggccaagtggggcagatcacctgaggtcaggagtttaagaccagcctggccaacatggtgaaaccccatctctactaaaaatacacaaaactagctgggtgcggaggcacatgcctgtagtcccagctactcaggaggctgaggcaggagaatcgcttgaacccaggaggcagaggttgcagtgagccaagatcgggccactgcactccaccctgggcagcagagtgagactctgtccccacctgcccccccaaaaaaactatgtcaatacaaaatattttgtgtctgtttaaccataggagtgtccttactgccttgtataaaattgctgaagctttgtgtatggtcttctacacaatggacacattttatgcaactaaaactgaaaagccgagtcaattatttgggtatatggaaatataactcatatttatgaaacgtttctaagtaacatttctacaatgaagatttataacacttaaagttagaaattatttccaaatatatgtacactaaaaatacctagatatagccgagtgcagtggctcacacctgtaattctagcactttgggaggccgaggagggcagattacttgaggccaggagttcgagaccagcctggccaacatggagaaaccctgtctctactacaaatacaaaaattagctgagcttggtggtgcactcctataatctcagctactcaggaggctgatacacaagaatcacttgaccctgggaggtagaggttgcagtgagctgagatggcgccattgcattccagaagttacagactatcacaattttcctttttatacttatctgtgtttctaaacctttctacaataaacctatactacttttataacttgataaaaaactaagcaaaacatgatttgtccacttgattccaactctgagaacattatcttctattaaatcaccattaaacaatgagcaaagctttgaaattttggaactttgaaagttttaaaagtgttgttataggcttttcttatgttcctggtagttagctaaaatgcttttgtgttacatgttgttatgttacagcaaagcaaattaacttatttgtgcctagcttggatagagcacattatgtgaaatgcactgaagtataaataaacaccaatgcaatacatccgaatactctatcttggagatctattttatcacttacattgtagttttggacactgtgtggaaatgccctgactgcaaaaagagggatatttggcaaaacaggggatcttcagaccatcctttgccttgcatgtgccaaagaagacatcacctactctggtgctttaaatggtgacatctatgtctggaaagggctcaatttagtccgcaccattcaaggagcacatagtgtaagtattaccttgtggaaatctgtgggtgacctaccaaataaggtaagaccacgaatccctccctgtatgtttcccttcttgctttagaatcagagaaccctgctgaacactccctactcatgataatttcccatattacatttgctcacctaaaggaaaatatatttcaaaagcatacaatgtaattagccctcaccttaactattaattgcttgatttatgtcatccacagtagtttgacagaacactagaactagctcatcagattcatcttataggcacttctcaaactttaatgtgcccatgagtttctggggaatcatgttaaaatgcagattctggctccataggtctgcgatgaagtcgccacagctcatcagtgacccatagtttgaacaggaaaggtgtagataacgattgctcttgtattggttggtaagatagattttcctcattctttatgttgaggtgccagggtgtcacctccacaccagtgtcatgagctcttaaggtacaatcagaaaccattgataactacatatcttctgatggtctgctcagtaagaacaaggagaaacttcttaccactctgctctcttttttgacacacatgaaaatgactacattgttgtatctacaaatgataaaattgtccctataaatgggaagatgatgtaaaaggcaaagcctatcatagtgaatggaaattgggtaaagatgttattggaaatggtaagcctttagcttattgcctccaaattgattccctatacccttaatatgaagaaaagtttaagcaactcttagagctatgacatttcagatctttcactatatgttgcaggtgaattttcttggcttcactaattatgaaacagctcttaaaataataggtcagtatttgtcctcattcacaaaagcagctgtcttagtaacctaatttctttttatactggatcttatgtcaacattatattcttgcagcacttttgaacaaaccaaataaagtattttcctgtggaggagcatcttgaaattcctaaaactatttcccatgtgaaaatcttcaaacgatgcttaacaagcgaacacaagtgctatttacattttcatttaggttcaagtgatacctttgtgagctcactgaggtacattttgggcacttttgtgcctatgaaactgttcatgttcctagcctcttatctctacttaattattttaggcagcaacttccatgaaacacctccatagttgtcttttctctctaagggccacttatcacataaaataatttgattcccatatctgcattaattatatttttgaatttttttaaactgtaatctttttagtagtggtaaaagagcacttgaactagtttgcttttattattatgattttttaaatgtagctgagatgaacagtgttataaatggctacttggtctattgtcagcatttcaatagagaacaaaggggttttatttttgtttttgacttgctatgtttttaaatcaacattcaactgtatctattcattatacttaggatggttgcaccattgagtattacctgttttaatcaacaggctggaatctttagcatgtatgcttgtgaagaaggctttgccactggtgggcgagatgggtgtatacgactgtgggacactgatttcaaaccaataaccaaaattgatctcagggagacagaacaaggatacaaaggtaatatatgtgttaagcttacctgtaactctggatgtgaaatataatgtgaagttctgtattcatatttgtttctctgtaccccattttaaaaaggcagtttatataaatatattgaatacaagcaaaagtatgttaaaagtaaatggatgtcctttttcctaattcgcacaaatgcatctgcatgaaccagcaatgctgcagccaaaataagcattctgatgaagttgctgaggtttcttaggagatgggattgtcagtgacaaaactgagacgttctagacaagttggttaccattaaagtgaatgtacccagcctctgaaaacaaacaaatgagaggagaaatgagacaaattttgttttaaatagctttaaagtagtagataattatagtagtagggattaagagcatgggctcagtcatgtggggtgggttcaaactctttttacctatgagagagttaagaaattgaacggcagtctcaaatttcggggcatctgtttcctcatctataaaatggagataatactagcaccagcctcccatagttgtatgaggattaaatatacttagaaaatgctcaggatgaggactaaatatacttgcaaagcgcacttagcactcaaactgttagctattctcaccatatatagagtgtatatatcagaatacaatacatcttttaaaattctcatggtaggcctgttaccttttggcagacaaagaatttacagccgagaaagattaaagtggaaaatgtaaataggtaagacaagaggaagtcatagcactgttaatacgctaagcacaggttgggaggttctgttcactccccacaggtgggccacagaccctgcgccaagggaggggtacatggtactgtgagccatgggggtccacaggatgaaaacttacccatcgttgttgtgaaggggaatctttttcagtgccgagatgagggagaaatttcctgagcatcttttagagaagaccctgtgacatagggctcaaagtcctcaacaggcctgaaacgagttgtttctcctgggctgttcctcatgaagcccccgctgtgtgacctgatggcgatgctgccacagaggttgttccataggccagatcatgtggcagtgcgcggtgctctctgccggccttaggtagatttcaaaggactgggagaaaacagcctagacggcatatccttcaggccatccttaaatagtgttgtttgcagcaaaactttgccaacagttgagcaacagggaaatgagctggatattgtacttcctgtttatacctggatgccagctgctttatgtatctgtgaaatacaaaaatgtgcatctaagtcaactaatccaggattggactcttgtcttctcacggaggctcaggatgctggtgtgcatacgtttctgaatactaggcacagagtttggcataggaagttgtggaatttggtgtctacctcaatgtagggacaaggagatcgaaggccttaagttctctgccatagagtgtgggccagggaaacttgatccggaaaaaacatgccaaacagatataagcttgcaagtacccgtaagagcaattttttttaagtacagtagccaaaaatgtttggtcctgaaccatgaaacttcttggtatatctttcaaggtaaaccagaaaccaaaacatgtacttagagagcagagtcaacttgccagatgggattagtgaccataaactgcctaaacgttggggagtaccaaccaggattcatgactctttttggcagttactccatttaactaatccaaaaattgtatcacataattaaggcataaattttaaagcatggggatcagctaagaagccattggtttacgctgctatacttttctgcccaatactgagtccttgagcctggctctcctgggagagttcagggaccagttctgaatgaggatctgtgtaaccaggtgtggtactgatcacatcagccccacagccaactcccatctacagagttaggacagtcagcgacgccctccgttatacatcagtctcagattcccgccccatccttaccaagatcaaagcacatctggctggtacacggtggacactgggaacccgaaacaagcctgcacctcataggatgtgcctgccctgtggtgcctgggcttggcgttgaccagggattggtgtgcatcttagatggcttactgataaggcggtagcctgcattttgtagggagaaacagattgtgcttttaaaggatggtatagatcatgttccagtttgagtcccagggagtcggagagggcacaggggctgggatggagctcctgggagagtggagatggcactgcttagcatgcagccccacagtgtggatgctgtggatgatgttaattttagaattgctgctgacgaccagtactcttaattgcttagtattttactttaaactgattaatatatctttttaaaactttgctttaaactaatatttgtgacatgagtttaatatgctggggtttaatttttgcccttggagcacccacctaaaattatcctctccccctggcttgggcaacattgtcacaaaaggccactgtgtatcatcaagcatcaaaagagatgccttcattccagtcctcagtgaaaaaacaatgtacatgtagcatcaaaagaagaaaggctcctggtttgaattactggtaacaactaaagtctggcccacccattgcttccaacttagggagttcttgagcctgcatggacagggtcatgtggggaaacttgctctgaatccctctctaaggtgctctgttgcgctcagccaggccttggtgccattattgcactgaagcaaggaaggaggatgttgagttccagagccaccttccatagctccgaacagggagagactctcagaaccggccctcctgtggtcttggaggctggctgcctgggccatcctgtgatggggcagcctctccaaggcaagtggaggtgtgccccaaatccaaagtgaggtagaagacccaacacaagtgtaggaattaaaatacataggatttgaggagataaaagtaatcaagatgtaaatagctttctggcgtagctcccccttcagccaggcaataccatacccttggttgtttcaacattagcaaagagctgagcaaataaaagggaaggaaagagggtgggaaaagagcaaaagaaagcagagtggacagaagatggtcaggtgtcctgtcctccccacccccccgccaacccctcatcccttccctcaaagaaggcttggccttctgctccacctctctttgcctcaaacaaaccaagtatattcgaaaggaacagattcaggcagagcagtgttagacttccttgccctcagtttggacatgaagcttccttgttctcagtttggacatgacagttttatttttataagaactatcttgatataaatgagctttcttctgtatttttgctatttgtgaaacagcgacactcgaattcatttcaatggaaatgta

SEQ ID NO: 1109 - DNA, 1503 bp, Homo sapiens
ccctcagattaaaaaaaaattattttgctggtgaatcaagagtcattcttggcaaaagcctgttttccttaatttctgcagctaaattggctgggggaagccgcacgtgcttggactgatgctgtgaactttagtaagtcagtttttaaaaattcccagtggtacacagtgactatcaaatattcaaaacttggctaggcacagtgtctcatgcctgtaatcccagcactctgggaggccaaggcgggtagactgcttgggcccaggagttcaagaccagcctggccaatatggcaaaaccctgtctttacaaaaaatacaaaaattagctgggcatggtgacacacgcctgtcgtcccagcaatcgggaagctgaggtgggaggattgctggagcagaagttgaggctgcagtgagctgtgatcgtgcctccgcgctccagcctgggcaacagagtgagactatatatatatatatatatatatatatatatatatacacacatacacacacacatacatatacataaatttggccaggcatggtggctcatgcctgtaatcccagcactttgggaggccgaggcaggtggatcacctgaggtcaggaattcaagaccagcctcgccaacatggtgaaacctcatctctactaaaaatacaaaaagtagctgggcatggaggtgggcacctgtaatcccagctactcgggaggctgagagaggagaatcacttcaacccgggaggcagaggttgcagtgagccgagattgcgcagctgcactccagcctgggtgacagagcaagactccatctcaaaaaaataataataataaaataaaatcaaaactcaaaagctaaactgagtgaagcctcgcttaattacaaatacagaagtaacaaatggagtagaaggtcaataatacacctgcgtattttatgatgggggaatcaccattcaagcataacacagtggttgtttatcatcaccatcatcaggcccagctaaaatgactgagccctggaagggctgttcacattccttcagctcaaagggaagtttcaaaatttcaattcccagggccagtgattcaagttattttttagaaagaaacagaggcaatgaggaagtacatgagattaagaatttcttctgtggaagataacaatttaaaataatactagatcctagacaaaaaatgtctacagctatctgaatttgaaaatatacacattaccattttttagaaaaggagactgaggaataacataacatcttattcaaaagcagactgcaaggggaaatgtcagaccccaatgcctggcacttccctggcgtctcagaggatccaatgctctgggtgcccttggctgtctcctcctctgtgaggggcaactgcctcctgatagcaacctctggaatgtcaacaagcacctccccagagctgctcccagatgggccactgaggaattcgtcgtgagcacagcagtctgctagagtttca

SEQ ID NO: 1110 - DNA, 156712 bp, Homo sapiens
acaaggttagcacatttggtctttaacacctgattgtcaatacatttgccatttttttcccctgtataccacataagagaaatagatgtttggtgtgtgtatgtgtgagggggcgggtgtggggtgagaagacgctgagacgctgaaatagtcacactgaaggtgggcgctgattatctgccacatccaggcatatgtcctatctttttaagattttttgaaataattatagatgcccaggaaattgccaaagtcctgcagagaggtccctgtgcccttccccagcttcccttacagcagcatcctatataatgataacattaaaaccacaaagctgacgttggtgtaatactaccaactagaccagacctcattcagattttattagtttttgcaagtatgcatctgtgcggggcagtgggggataggtctatgcagttttatcacagctagagattcacgtacctgccaccacacacgtgctctcttacctctgaggtgggtgctacccccattctaaagaggaaggagtgaaggcgggtgagaggagggagcctgcccgagggcataggaggagcaggcatggcgcccacgccctgctctacagcccacactctttccctgctctcagttggattttcagtgcgggatgcatggccaacctctacccagcaaggccctcttaccccggccgagtttcctcggaactcgcggagccgccgtcggagctgcaggcagtgctccaggtcctggcccaggtcaccaacattcatcttcacctcctgtgaaggccgagggtggggagggagcgctgtgagcaccagcccaggctcctggcacctgctgctggggatccctcctgtcaagggagggctcctccccccatctctcagcccccacccagctggggctacaccttctcctggatccaggcctctgcaaggtccactctctgcaggaactccaggaagttccgcctgtcctccagctcctggcccctgagggccattgcctgcctcaggtcctcccagtgcttccgcaggccctgcagccgctgggagacctctccggctcgagggtgactctgtgccaggagagcctctcccttctggagggagagaggggacacaggacatcttgcctgctgcacttcctcctaagactgacattgcccctgggccacactttggggcaggcatggggctgagggcccggttgttaccttggcaacagaggtcatgacctcctcatgggcctggacttcagcctcaaaggcctggtgtttcagcaggggcttcagcttatctctcaggtccccaggagggaccggctccttcagctgctgggcccacgcctggatccagtcctcagcctggtgggggtgggacatgaatgctgcaatgttctgcagcctcaggccccagacgccacaggcctagcccccagccattcccaggaggctggcctcaggggtggggcgggcagcacctggtaaatgagccctgaaggttccagctccggaaggttgctgcaggaggcagccgggcagggccttgggtgggctctcgttttggaggtgtggcccctactcctggggccctgggctgctctgctcccttccccacctctcttgccctggcgctgctagagctcgggacactggtgaggtctccacacaaaggggcttagatcccatgttctgggctccagcacagcctctgggaaagccatccacccccgaacctgtttccgcctcacagtgttgcggtgtgaaggcggctgaaaactgtcgagtgtggttccagtggaaggccctgggctgggggtgccctctgacctgggttgcggcctgggtgaagctggccatcagcagggaggcatgcagggcgtgtccccggctctccgccagctccttcactctcatccggcgctgcagcaggatgggaagccggtcccgcacccgggggcgccggagcgtcttcagccgctcacgcagggctgcctcctgtggggcaggggcacagctgctgctctcccaccctgggctggggcagggcctggcctgcagggctcacagtcctttctttgagggccccggagccctttcctcagccccacatggctgaggggtatctgatcctcccagccacaagccagaccagtctgctccccaaggaccacacggtgtggacagagccaaatgccccgtgtgggtctctgcagtgtggcccatctccccctgggccctcttcttgagccacacatacaacttgctcagtcaaccccaaccaggaccccagccttgcaggctcatcagcactgcctccaggaacacaccaagcgccccgtgacccccttcaggactctctcccaaccaccacactctgaccacgcccaggcctcctgactccattaccttcttgtcctgggcagtcagaaccttcaggaagacctcgtgcttgcgaatcaactgctctacctcttccaccgagctccccaaggcactggttttcagggagacctggatccacagaaaagtcagaggccaccaagccttccagccagccagcccctccagctgcagtctgtgcccatgggcactctgggtatggcagggccttaggagtgcccactgagcttggcatggagctgtgaggagtgggagtccaggttgggaggctgcgatacctcaacctctgcaccatgtggggagcatgaccagcctctggccaacttcctcggggctcagtctgggataggggctggggatgtcagtggacgctcaggggcctcagcacttcaccatggccacctggaaggacttgtgcacagctgcctcatattagagaaaaagccagagaggcaggaggaaagggactgagcagagaggagaatagaaaggaggagcaggaggctgagcggagtgtgagggcgggaggggacctgcctcctgggccgcgaggatctcctccaggcggccgcactctctgaggaagagctgctcctgctgctcggcctgcagcctctcttgcttccgtgcccaggtctgatacacctggtcccgctggtcctgcagggctcgaagctcttcctggacctggggatggacacatgaggagcctcagctggggagggtggtgtgggtgaggtgaggactggatcctgagggaagctcctgaggagaggccagcatggcacagtaggacggggcaccaggtggccaggcacaggcttggtcagctagggtatgtgggggcaccaggggagggggcccacctccttggtgggtgtccctgcagcaagaagtgcctgctgccccagctgggtggcctgctgccacagcttctcccgggcctccagctccgcccggagccactggtgggcactgagcttcagcgggccactgctaggctcttgcgaactctcctccacctgcaggtcctggcgcacgcgggctgcccaggaggcatagtcacgcacctgatcccggggacacggagggagagccgggtgagggctgggctgggcagcaggaaaccaggtgctgaggcaactgcagcccacctgagtccactcacacagcccgagccgacctgggtcagggcctcgggtgaggcacatgtggccctttgtcacttggtttctccgttctcatccaacccgatcctcccagaaccacgaaccccctacatgagccagacccttaccacgacacatctctgccctttgttcctcctgccttcccatctctacagagctcacctggatgaggccatgagaggactggcggctagcaagatcagccccatcaagactgcttgatggggaaagaaagttcacctgctcttcaaaggccccttggccgcatttgcctggcaaagccttccctggtatttgacattgcactgctctccttgttctctgaattactaatttaacccttacagtcttctgctgatttgtgtacaactatacaagattggtgctggagggacttcaggcccttgtccaaatgtctcattgcatggaggaaggaagggtaaatggcagaaagagtcttgtaaactctaagtgcatgacaaacccagggttaagtgccttgctcaagctcacactgctagcaaatcagcagagttaggtccctaaactcaagcctttttgcagtgtcagtttgggcctcctggtctgccaggtcccaggacagtgggatgccggggacaccccgtggccaggacctactgtcccagtctgattctctgggtttcgggctcatctccccaggaagcagggctccatgagggcagcagttccactttccatagcttctatattgccctcctctctccacccgtggcttcagcagggagctgaagacagacattaaatagatactgactgatccagaggtcactgtctaacatctgggtctccagttatgagctttcctgggcagttcttactcccagccctgtctgggaccctgcatgactgccctgccactcaccttgctggcactgacccagaccctaaggtgtcactgctatgcccatgtgctcagcccctgaccagccagactgacatcccgtgtgctcgtgctctcccacccaagtccatgcttgttctccctccggagctggagggcctcatgcgtgcatgcccatgcatggtgcagcacacacacatgcacacacacaccacccaaagggcaggagccctcaccgccgtgcggaagcgggccaggaggcgtgcccgctccagctgggccctgcgctgctccatgcgtcgctgcagcactgcccacgcctgcgtcacagcttgctgcctctgctgcaccgcatgggcctgaggccccggacacagcttctgcaccctgcctgcagtctccagcagttcctgcagctgcgggaggggcagggaatagggaggcaagggtcatgtcctcctgattatcccacagatgtatcccttgcctgggaactctggcccccttgggccacgtcctgccatgcacaggaggcccatgggaggccctgagggacagtggaaaatctagaggaacaggcaggccagcctgagggggctgcaggggcctgggtcggagaggcagccagctgggctcacctgccgctcggtgcccacgagttctcgctccagcccctggtggcttctcagctgcgcctccagcccacacaggtcccgtgccacattgttggggaggctcgtggctttctcctgaggaagggagaatgccgaggagatgagggatggagcgtgggcactgagcctggagtgtatccacttctagccacccctccggctcacacctggacctgggtgaggacttccaagagatctctgtgaactctgagggtggtctcggtgtctcggagcgcgtggcctcgggcctgggtcagctcccacagctccgaccaggcggtcctgcccacggcgtgtggaagaccagccggggatcagctgccgggccgtgtcattcctccctcccgctaggtctggtcagcccgctcctctctgagttgtatcgggacttgcccaaagctcctccttcttaaaacctctcccgcctgtggccctgcctacgcaccttcttcctgggagcctgtcttctagctttaccatgaattcagtgctttgctgctgtaatgctcggcactgcatggtatctgtgctgtgatactctttacatcctgtgctttgactcacagtgcgtcacccaggttatgatcacagacgctttgtgggcagaggccacatctctccgttcctcgctaactctgcaactggctgagctcctaaggcttctgccaggccaggctctgggctaggggttatgagcaagtcatgaccttgcctcaaagctcacaggctgggagtggatccaaatcagccaagtggacagctaggaaccacacgaggcatgggctgtcccgagtgagcacaggagctggggtagctcaggggaaggccctgatgtctggccccaccatcttcccacagctcctgctctcaatcctgggggcaggactctgacctgcacacccagcctcaccttccttcacagaccagagcctgtggcgggctcagcttctctggagctaggccccctgcagagccccgtgggcagccagggccagtgtggccctcacagcatgccatcctctcttaccactctgggccctgcctgcccagctccttcccccaaaccccatgctggcctggcccgttgggcactcactgcagatcctgctgcctctgacggaccatggggccagcactgtgcccacgctctagcaggctctccgccagcagccggcaggcggccacccgctggctgcccatctccacttggtgctgaaactttgcaaacttggtgcagaggtgctgagaagaggggagtgggtgacagggtagcccccagctggttaggcgtcaagcagcctgggaatcgaggcacctcagtgcccaactgggtgatgtgggcttggatagccacggcgtctgcccgctccactgaggaggccccacctcagccagggctcaccgctctgctgccaccttcttcctccgccccgccagagccagcttccccaccccataggctctgcctcagggcaccctccttgaccctggccctcttctcaccagggcgtgctcggggtcctctcccaggctctcccctcctttggctgcctgcttctggcttgccagccagccctgcaggtcctcagcctccctcaggaactcatgcagcctcagggtcccctccagttcccggtccctgtggtaacagtccgtggttccccagaagtgagttgcccacccccctgggggccagtcgggccagccagaggggccaatctgaaaactggggttactcatggtctctgtccaagcctgcggctcacgattcagggagtagtagacacagcagtgcaggtgtaggggcagaggagggtgtggacgtggggagatggactgcagggagttgtggggcctcactgaagaatttatggaaagaggtgagcaacacacacccttttcccaatgcatctctacagcctggggtcatgggttctgattgactttgggccatggcatgggaacagtcagctgtggctaggcctcctgtacccactgatgagaggggttatggtgtcctcaccgtgtggccgccaactcctgcagtgcccgcagctgctcccggagcctctcctgcaccacacgctgctgctcagggacttcggggccagtgagggtttgggccgtctggtcaagctcctccatggagctccagtaaatggctagttcctcctgtagagcctatgatgcatgaggacccatgccaggctcagcctgggtgactcatccacccacctgtccgtcccccacccatccagtcaccaatcctcatccattcacccaccactcacacgcccatccatctacctcaactcattcatccacccacccagcatccatctacccattactgatggagtaagtacttattgttccataaagtgaacacctggtctgtgcccactgagggctcattatttagcagggaaaggtgaatgctggctaatctgggccaaggaagggagggcacaggaggcattagactggaccccaacatccatgtgtaagagagaggcagagttaaacaagctgtccagtatagccgggagatgggtgctccgtgaggccaaggctacaggcctttagaaagaccttctctgaaggtcctgtcgcagaacacactggaactggggctgtgcaggaaacatgcccagacaggaggacagttcagtgacagcaggaaccgggactgccgtgggctccaggctttgaagcttgtgtggttctgggagtccgaattcaggagtgaggaaggggacttcgagacctccctcccttcagccaggggatgtttgtgggaggaggtcggcttcatgaagggcatttggttaactcaaaggatgacaggtaaagcctgggaggaagacacctgtgggagatgtggagcgggctgggcaggtgaccttgacagaggagaaaggtgccaggggtggggtagagaggaagcaagaggaggcggagaaaccccaaggccacagggagaggcaagactcgtaagaagatgaagggagaaagcgtgtacatcacagtgcccaggttgccttggaagaaggggcactgtgggatctgggtgggaagtggggatggggctgtctgtgtctccaggaagcaagagcagggctccgtgcctctgagagagggagggtgacagccctctccccgtggtccatcatcacccagaccacactgcaggggaggctcaggacgtggtacctggtgcttgttaatgagcctgagggtggctgcctcgtctctgccatagtcccgactgctcaccagcggccgcttctcctccacccagccctccagctctgacacatccagaaagtactgccaagagtggggccaactcacctggaggatctcagacaggaccctccgtcagccctggagacatctgcccctgctctccagcatcaaaggggcttctgtgcccataggggcacccatcagctcccagcccagagcccccaccactgatccgcctccctgagagtcccacaggtggcccctcaaggagccctgacttctgcctcttcccccaaccccacctctctgcatcctacctgctggaaagtgacagcctgctgcagacactgggcccgcgcttcacatgccctctccagctctgcccagtggccttccagctcctggcactgctccacgatgtgttgggcttgggggtgccctgaggctgccaggctccgcccagaactcagcacccgttgcacctgcccctggtgagcttttacctccacctggagctcctgccacagagtggcttgagaggctgctgctcttaacccaggggcgtccggagcagagccatggatgtggctccaggccccaatcatggcaagacccccagggtcaaaatagctggggcagagatttggaaattgggatacccaggggtgagggcttagaggccaggacacctgagtaggggcagagggtttctaaggtctgggaagcggatgtcggtaatcctgtaggaagaagagggctattaccttgtgcttgcggtgaaggctctgggcaccattcaagcactcggtatagctggtggggctgccatggggcatgtgctcggctacccaagagagctccatgttgctcaggtggcagaactggtgcagctccactgaggcctgcagctgcaggccccggatggccagatgcccctgcagaagctccagcctaggaggaggaggaagagattggagaggttgggaacagagtgagcacaaggctcctggttctttccttggccaagccagggcccgtgaagaacaagaccagggaatagagcaaagcctcatctgacaaagggaggcagtggaagggcgccagggccccacctcatggcctagatgactcgcgtgactgcactgtgggggtcctgctaaggaagcataatggggtctccgaccctcccatcccagaatgactctactcataagggaggaggtctggacaccccggtcctgtgggtgccatcttgtgggaccttaaattcacatggaggagtgacacacaggtgggtgggaggacagaccccacctccggaggtgcttctgggtctcttccaggatggccggggaggcggccatgccatgggccatggaggcgagggcagccatcttggcagccagggtccggctctcactctccagctgttggtgccgtttctgcagcctctggctggagcgcaggtcctgccctgtttccgagctctgtagggccccttcgagctgctccagctgctcctttgcatcctgggagggacgcatggagctgcattaggttctctgtgtacagcacagcaagtggccttcccgggctctgggactgttggacttttaggaccagattcaccagggagctctgtccccaccactgccaaccctcggccagaagtgcccaatcttcccctgttccctcacgcttcttcttccctgggggactcaagtggtgctgaccacccgctgggcacacaggagagaatcctgcattggccgactgagcggaaagccacgctcagcttgtcctaggccagaagcctccagaggctgcagagccagggtcagcagaacacccagacttctccctccccgttctgtccagcccagccaggcctccgtctccctcttgtgccctgtccctcttcccagtggacctgcagctgcctcaggagttgctcctgctgtccagcctgctggagctcgtccccacgctcagtcatcttgcggttcaaagcttcccacttgcttctcaggccttgaagcctggtctgtatgtcctcctggccacagggcctcctactcaacagctctctcccaacctggagtggagataaaggcccagggagtttggctgagctgctggtaccaccagtggccgcagcaggctggacctgggtggcagtggaggtgagggggtgaccacagctgcactccacgggctgcctggaagaaagcagttcatgtggccccaaaactgcaggtaggggggctttcctctgacccctgcaaatagagcggggtgagccggcattaggttggtggctggggagagccgtgttctggtagaggtggccggctctgggacttgccacggagagttgtaggggaagggatggatggcagcagctttgggactggtttgggtgccaaggggatgccagcagcatcaaggaggcttgcagggggaggttctaggttcacgctgaggctgatttttccttcaaagactcttccatgaaaacaggtggtgcagtagggttgggaatttgaagacaaggaggctctgcaccctctgtcccgtgtcccccacctgctgcagggcctccacgtgtctgcgggtggcgagtagctcgctctcagctgcttcgtgccgcttgagtgtctgcaggatgtttctgcgcgctccggagggctcatgcgcagccatcagccccttctcttccatccactgcatcagctctgccacatcctgcttccactcctgccaagaaccaggcgagagtgggtctcagagcacggtgggtgggggctggtgcctagccctgcatctgagggtggtgtggccacagcccctgttttcctcctcaggaaaaacctgagctgtgttgcctgcctcacagaaggtgttgagaggatgaatgacatagcgcgtgaggaaagtgctctgtaggctgcacagagctctgtacggtctcaggctttcttttcagggaggcgtcatgcgacctgggcccagaccctcacctggagctggagggaagccagcaactgcctcctcctctgctcactcctcccctggagcctggtccactgtgcctggatactctgcagctgctctctgaccctggagggcgggggggggttggaggagggcatgggagaggactcccaccccagcacgaggtgcactctcccccaccccctactctcccagccctagggcggccgtctgtgcaggctgagaaagggtcatctgcaggtgctgcagactgaggccaggctcacgtgtgtgcagctgggtgctggctctgaaccagcttctcgccgtgtgcccgcagagcctctgcccgaggccccagggtgctcaggagccgcccaaactcccggtgctgctgcagcaggctcagggcctccctcacgtcctcctgggagtgcagagacctgaggtcatgcctgggagaatgggggtcaggaccatctcacccgccactgccccaggggcctcctgcccagcctggcttctggactcaaggggatgagctccctccagtgatggggagtgacagcctagctccacattcctgctccataccccaaggttgtccaggtgcagccaggcctggtggttggcacaggtggcagtgaaaccatccacttctcggccaaacttctgcagctccagcccctcttgcagccactgctgcctctgctcccacaaaaccttcagctcctggccctgctgccccaggaccctcagagtgttgggcacctcttgggagtctgggcagtccaaggctgccatgggctggctctgagcgtccagctgctgcagcctgaccaggatgacaggcagagagtcaaaccccagcaggctccctcgtcagcctccttctcctctcacctccagggttcacgcatcttggatcatgaatgagacactgaatgtgataggcccagcagagtgcttagggtgcaggggttcccaatcccccatcggctccagccggccgtccttaagtgtggactgccaacagccgatgcccggcctagaggacatgcggaggcagcacagtgtgagagagaaaaatcacgcaagccacaaaagcacctgaccgcagggccactgcaagcccccatggaggctttgaacaatcagaaaaggtgctcctttcagcaggtggcttgggaacaggtaacacccttgtgtgaattagagcaaggctccacttcctctgagccgctgcagaaccaggtactggagtctggcaagctgagggccagatgcatttcagtgcccacttggccacctgtcaagtgccttcaggaggggcacagcctgtggactgtccctggtggccttgcctgcctgccagcccataacgtcatccctgcaggaggagaggcgccaccttactaaggaggtggggatctcagacccgtgggtgggtcctgagccattccacttaggggccgctggggtccgtgttaccaggacggcagggggggctagacgccctgactgaaagcaatgcatcgggcccacctggagggggccagccgggcctgggctgcagagagcctcccaggcagctcagtgtcctgggtctctcctcgaagtgtacaggctgcctgacccagtcctagattatatcctcctctgtgtaaacttgcctcaagcagcatgccagacaccaaccagtctgggcccctccctggggaaatcacactacttcccgcatgctctttctgggcctgaacccagagcccagagccctggtcccagcccaaagtgcaccccttctgccctcctgtcctgacctctcctgccacaggtggatctcctccagcaggtcttggtgctccctcagcagccgctgagccgaggccacatccactgacacctccttgctgcgcagctgagcctggacactctctgcccacagtagcagttgctggctctcttgcaggaagctctgccgggcctgagtctcagcctggcgccgggcccgttgggccacttgttcctgtacttgcttcagcagcccctgcagtgtctccacctgtccttgcagaggctggctctctgcgtagcctggctcctcgaccctgggagacagggtgcgctgcacagtcagtgccctgtcctgggcctggtgccccaggcacatgtcctctctccaaacctgcatcccccagggagagtggtgctgactctcaatgcccaccccacccttgacctgggggcagcaagaacatagggctcgccaggtgcagtggctcaagcctgtaatcccagcactttgggaggccgaggcaggcagatcacgaggtcaggagatcgagaccatcccggctaaaacggtgaaaccccgtctctactaaaaatacaaaaattagccaggcatggtggtgggcgcctgtagtcccagctacttgggaggctgaggcaggagaatggcgtgaacccgggaggctgagcttccagtgagccgagatcacgccactgcactcagcccgggcgacagagcaagactccgtctcaaaaagaaataaaaaaacatagggctcttcctgtccccaggaccattttctcctgatcatccccccatctttgccacagccctcctacctgttgtctccccatcccaatttctgtcccttcctcattccactgccctgcccacgccttcccatggtcctcactgcctcccaatgccaccactgcgctggccgtactttacgaccacactttggaggaagtggaccctcctctccagcaccagggtcttcttctgggccagctgcagggcgtggcaggtgtcctctgagctccctggctgcagggcctccagctggaggagcacgtctcgcagctggacctgtgtgggtccacactcctgcagaaaactgcacacttccacactgtgtgccagctgcacggccttctccctcttcagggcctccagctgcccccacctgggcagagggtacaaggttgtctccacaacagggacacctccccatccatccgggagccttggccagagcctcacgtgacagaagctgccagactggctgtcccttgccccttccctgtgcctcggacacgtccagcctctccatctggcatggcgggaggcaggtgagtcaggcccaggctgggcactgtgtctgcctgcctcaccacctgcactcctgcctcattctcacctctggctcagttcctcctgctgtcgttggatttgtgtggagttcccaggatatctctgcctcagttgctcagcagagctgctgacctcagcccagaggccctttcccacagccagggcagtgaggaagttctagggaaaaggaggacccagccctcttgggggactttttctctttccacactcccctctagcctatgacggacctgagtggtgctctctgctacagggatgctcatgctgcctgcccctggaaagacagccatccgagtccttaagggccaggaggccctcgaaattcaggccagctctctgctcccctcccccaggcaggacggtagttaaattggaaaactgagtcacagcagcagaccacagggaggcaggggcaaggcgaggaggaggtgccaagctcccagggctgtacctcatatttgagctgcatgacctccagggtgtcagcctggggctgcaccctttggagcagcactgtctgcttctccagccacaactggagctccccacaggaactgcagaaaccgaacagggccatggcctcctccaaccgggccctgcggagctggggagaggtggcccaaggctggggtgagggtcagggcccccgacagggctctcagagcgggtcaaaggggtgctcctccccatcccagcccaccagcagagcccagggtcagggccagagggggtccctgcctcactgctgggccccacatcctctctcagagccctcttggcaccacctggagggagatggcaagggcttagggaagggtaaagggcactggcagtgtgctcctgtctggtcttgccctgctgaaacctctcagtgccagccctgctctaaggtgaaatccacgccgctccctctgcctgctccacccccacctgcctctctagtctctcctctggccatggcctccccagcgtctgtgctgcagggacctgggccttcgcttcctccgctgggcccccttcctacctttgcacaggtcctggccagcacccctgggtttacctgctttctgtttctcattcaagcctcagcttaaaagtccttccctccaaggtgccttccctgacctccagcctgacctgggctaccttctcatgtgatcccatcacacctgcatctaatgagttgtctgacatcttctcagccatgataaaagctccttgaggacagggaacatgtcagtcactgccttgtcccctgggatcactgcacaggagctgctggcacagagtaaggactcgagcatttcttgaaaaagaagtgttacctgtgccagggcccgcagactctcatagtcctgactcaagtggtcctgtgtctggagtatagtgttgggatcaaagtcagggtcaggctcagctgggagggccatcttccaggcatccccagggccagggtggcaggaagcctcactccagggccctgggttcctcaggctttctcctggagggctcagggcagagttcacctgtgtgacaaagggcagcgcgtctacaggcgaccccatcaagcagcaggggctttggccaggccacccctacctccgtgccctgagacctggaggcgctgagctgtagctcaaagggtgtgtgggacatgggtctgggggacaggaagcttccttggggctgagggtcgaggggccaaacgtgagcacaggatctgatggctttgatttccacatcgtgtgctgcatacacagcttcttgaaagagggctgtgagccaagctatacgtgttttaaagaactttgggggctcaatgaactgagcaaggggtgtcagaaggcagtctgggtgagtgatgaggccaccccaaaccaacaaggcgggctaagtcaggagagacagtcactactggcctgggtgaaagtggaggggaccttcctggaggaaagtgcttaacggtctgaaactgccggcaacaggagccaggccaagctgtatttggatgccctcggttgacgtgggcagacaggattccactacttctgggctaggtcaacaagtgagatgccactgaggactggggtgagggacacctacacccacgggaaggccacgaatcctgggccagaggccacaaaggccctcccatttttgtcctctgtgtggcccagccgcggtggagcaagggagaccaggcgcccttccctgtccccgtcctcaccgtgaataacgacgcccgggccgaggccgcccgcccctgctcctccagccgccgcagctcggccgcgaaggcgcgcaggacgcgctccagccgcacgtggcgcctcagcagggtctcggcggccgcctggtcctgaccgcaggacgctctctccagcgaggatcgccgctcgcgcagccacgaagccgcctccgccgcgtccgcgaagtactgtgggagggggtcgggggtggtgtgggtgaaggggcgcggctgagcgcgggcaggtgctggcacccccacccccgcctcgccgggccccgcccccaccccgcctccacccctccccactacctgcaggaccagcagggctgtctgcagccgtgcgccccgccccaccacccgggtctggagcagctgccaccctccctgaacggcctctgcccgttccccgggatccggctgcgttgggggcctgcgggcgctgaggtcgcgtcccctccgcacgagatctacgcacacggcctggtggcggtggacctcagcttccagggcctagcggggggcagagcagggggctcagtgaaggcagaacaggggagggggccgggggcccgagagggaagggcaaggcgctggcgaccggcgggcgcgctcggggagctgacaccttgtgtttctgcagggcgcctgcgatctggctgagatcccggcccagggccgcattccccacccgctgtccgcactccttcagccaggcttcctcctcctcacagttgcgcaggaactctgcccgctgcagggtctgctccagcagggcccgcctgagggacaataggggccaccgaaggacatggggagtcgtgaggcatgggcagtgggttcccctccgggtttagacactccccttagacaggatttttcttttccctggatgactcaacaggtgagacggaggctttggaagtgagggtcagtgtggagaaaactggcaggccaacagtactttaacctgggcaggagataatttgggttacagaaaagttctgggaaaggtggaagagttggggcaggctcttaccgggccctgacaagagccaccaggctctgttggagctgggccagtgtcctggccttggcctgcagcacctccacactggtgcccagggaggagtccagctctgctgtctgctgagcaagatggctcacatgggctccgtgggccgagacttgagcctccagcaggtcatgcctctgcagcagctccaccacttctgccagctgctgcccacaggcggtggacctggccggctcctggccagagatgatggtcattgcagtggtcccaaggtgctgggtccctctgagcactggcactggggaagtcccccaccttgctgtgtttcccaagggcctgctggtccagtgcccacctgcagctcctccagctggtgggaggcagcctccacctcctgcagcaggctcagcacagcctgcatgtctgccacctgcttcctctgtccctgtagatgctgaaggagcctctgccagcgcacggtaacttcctcctgcctagaggatatgagaataagggagatctcctctgggttggggcagggaagctacttcagggttcctggtctgtggtggggcttggctgccctggaagagtctgacctccatggctggggcaaggtctatggactctgacagcatcctggcaggcggtggtagaggcagtgtgtcctacctttggacacatgcagagaagccagaaggagggcctggaaggatcaggcctttggggccccctaacttggatgcagtccccatttcagttgatgaaaactccatccttccaggcgcccagactaaaatctttttttttttcttttgagacagaatctgctctgtcacccaggctagaatgcagtggtgcaatcttggctcactgcaacctccacctcccgggttcaagtgactttcctgcctcagccacctgagtagctgggattacaggcatgggccaccatgcccggctaatttttgtatttttatttttatttttattttttatttatttatttttgagacagagtctcactccttcgcccaggccggactgcggtggcacgatctcggctcactgccagctccgcctcccaggttcatgccattctcctgcctcagcatcccgagtagctgggactacaggtgcccgccaccacacctggctaatttttttgtatttttagtagagacggggtttcactgtgttagccaggatggtcttgatctcttgacctcgtgatctgcccgcctcagcctcccaaagtgctgggattacaggcatgagccactgcgcccggccaatttttgtatttttagtagagacgggtttcaccatgttggccaggatggtcttgaactcctgacctcaggtgatccacccgccttggcctcccaaagtgctgagattacaggcatgagccaccaggcccggcctaacatcttgataactcactttctcacatgccacatctgatctgtctgcaaattctacttggcactacctgcaaaatctatccagaaccccaccccttgtcaccactgctgctccgtcctggattactgcaatagctttgtaactggtctctctgcttctgcctttgccccttggatctattcccaacatgacatccaggtgagcatcgcaaaacaaaagtcagattgtgtcactcgtctgctccagccctccactgatttcccatcatctctctgagtaaaagccaaatcgttactgtgccctgcaaggcccgacttgacctccttccctacctcgtcacccctgtgcccccctgacctcagctcctgccacttgttcactttggccaacactggcctccaggctatttttcaaacctgccaggcatgtgctcgcctaaaaggacactgcatttgccgtttcctccgcctagaatactctgtctcccacgtctgcatggccagctcgtcacttctttctggtttttacttagaagtcaacttcccagtgaatcccctctagccactcaaacttagcacctcatattcattcccctatcctcctttattgttattatttttggagatggagtctcactctgtctcccaggctggagtgcaatggcgccatctctgctcactgcaacctctgcctcctgggttcaagcgattctcctgcctcagcctcccgagtagctgagattacaggcgcccgccaccacgcctggctaatttttgtattttttagtggaaacggggttttgccatgttggctaggctgtcttgagctcctgacctcaggtcatccgcctgctacggcctcccaacgtgctgggattacaggcatgagccaccgcgcccggcctctcctttattattattatttttattaccacatgctatgaatttttcttatatgtctgttttccttagtagtgtgtaagttcatgagggaaggaatttttgtttcttctcttctctactaaatctccagcacctagcacagtgtgtgggacatagtagacactcaaaaaattcttgtttagtggatgaatcagaggctacctagaaagtgaaagtgcttcaccaataggaatgaattactgatagtgggcttgcaagcatcactgggagatagatctttgtagagggatccctgaacccataaatcatccctctcctctctggcaaagaatgggcacatgacatggaaggatgggggtgtggtaggacagcctcagccagctgtggggagagttcatgtgctggggctcacctgcgggccacatctgcccagctgtggtactgctcctgccggaggatgtctgcgatctcagccagggcctggaagcgcccctcctggggcaggatgccagcctccagcatgcccagcctctggacggctgcctccactgtggccaggctggctggcggggctctggcctggtctagcacctgctctgcatccttaaggaaactctcccggagggctgccttgtgctggaagcgccgggccagggtttctagccgctgcagctgcagtagcctctgctgcagggcctggctccttgcagcctctgcccactccagccctgcccagcactgggacagctctgcaaggcccaggccctcatgaggcaggaagggcctgcggttctgggcttggagtgctgtctgtagccggaagagcagggcctctgcggcccctcgctgctgtagccggggtggcttctcctgggtgcggaagatggtgaatgctgccagtagctgccgcatggcgggcagcgagtctggaaaatcccgcgcctccagctgcatctgcttctctgcaatccagcgtagaaggtcagccaccagctgctcgtactgggtctgcagcagctctgtctcctggagctgaagcaggatctggtggagggcataggaaggggtcagggtccttctcagggcaggccctggaatgggcactgagtgccagccagagttccccaggtgggctgtagctacttctctgagccaaagatgctttgaagtggtggtacccccaccccagagaactgggtttgcttggattgcacactcagacccaggagcttggggaccctctccatgactgagggtgaggctatcctgccttcttcctcttgttttacccatttggcctcactggtggggttgaggcccttcaggctgctgttctttttctaggccgcctttcccttccctgagcctcctaccccataaagcagctcacagcccttggcctgtgtcacccccacccacaccccaaatgagatacccaccttgagaagagcacttccaggccttagcctctgccatcgtgtccagagagtaaggaagccccccaaaaacatgaattctgcgtagcccccgctggcagagccttttctgtgcctgtccttgcagaatcctggctctctaagccttttaatcccattagaagcttaatagcccgagagtcgggaagaagggggaggcccaggaagggccattcctcccctggcttcccttgtataccaggcaccgtgctgggtccattacccatgctccctggaacactcacaagggccttctgttatccaggcatcatcatctccatgtgatagagggtgcacagtgaagttgggtgacttggccaaggccacacagctagtacgtggcagggcaggcttcacgcttaggcctgtctgcctctggagcccttgctcaccccacccctcctttctcccccaccttagtgagtctcctctggacagtctgcccctgatgcaggcgggagcagtagtggtagtagagggagacgtaggtcatgatagagcgctcatctggctgtgcggctgccacgtcctcggggtccagcagctgagcaatgcccagctcctgctcagccaccaggaaagcaaaagcaaggttgtgcagtgggcggtctggacgcagggagccgtagtccaacaggtctggcctggacagacagtgagaagggctcttcaccagcaggaacctactgctttcctttaagtagattcttaaatgcactcatgctcctattggccattcacatcttcttgtgaattcgttttcccgacagttatctgaggccctgttgaaggaggaggactctgacagagaaagaggagagttcattcggcacagggaccaggctggggggctggaggaatctccaaagggcaggtgctgcagggtgtagaacatgaatagaattgaggggcacagaaagtggagaaggctggggtcaaaggtaaacttggccaatctcatggcattgtctagggaagggaaaggggctaacccatcagccctttctacatctgtgtccactttccctccttcaagcctagggatgtgggagaacgggtgggctgaggacccaaacccaggagctgttggctcagtgggcagaggcctcctgacaagggtggggtcacacctgtgggcatggatgagggcattgaagcccagcccatcgctccagcttcgggagaaatctgtaatgttcacgttggtgtagctggctgtcttccgctggcaccagaccagcagggcttccttggtggacagcagggctgcgctggccccaaactcctcctggcgggacagggcagcagggtcaccatgcggggatggggtggggaggcagagagcctgcaggctgtgggagaggcaggctggccacagcaggatcctgctcctccctggcccggggccagtgtgactctcctctcttcagagtatctgattttgcccaatttcatccacggtgggcaaggattgggggtgagagtgactggccttccaaagaagtggagcaagggaaaagccgtcactgcagaggcgctggctttgtgtcaccacaggtgatcacacagcaacagctcccgttttttgagcccttctgacgggccaggtgctgtgctaactgacctaggctcatgggattgtggctgggcttcatgaaactgggtcccgtcactgcaggctttctgtgagccaggcccagtgttatgggctggagtgcagtggcacgatctcggctcattgcaacctctgcctcccaggttcaagcaattctcctgcctcagcctcctgagtaactgggactacatggaggcaccactatgcccagctaattttttgtattttagttggaacggggtttcactatgttggctaggctggtctcaaactcctgactttaaataatctgcctgccttggcctcccaaagtgctggaattacaggtgttagccaccatgcccagcctcacttcctgtttataaactcaaaatatcaaggctcagcaggctgcacttcccctgccctctgggccccagagcttgggtaggaaggacgtgcatggtgcccacatgagggggagtggagtctcgaggccctgggccccagcgaggtcaggccccagtaccctgcatggtggggccaggctggcagacggaactaaggaaaatgctgggatggcttgtgagggatcggggctagcctgagcccaaacatatctgagtcagcagggagcagggctggagggggctgcagacagacagagacggtgctggtcagggaggatgcccacctgctgctcccaagggcctgggctgcaggggacacctgaaactggccaggggcctgaggaggtgagtatggcttcctgaaagggcttgaggtcagttagaaattcatccgtcccttcagccttcaaatagatgctcagcctgcagacacacaagacccctgctctcctggggctcaggccctgagtttccaggccatcctggacttctgccagatctctggcttcttttcatgagggtttcattctccaggttggctttccttacctactagaattgagttttaggtggcattttggaaatcatgaaactatgaaaaagtataactataaggactctttcttttttttttgagacacggtctcactctgtgacccaggctggagtgtagtggtgtgatctcggctcatcacaccctcagcatcctgggctcaggttagcttcccacctgagccctcccgagagctgggactacaggcatgtgccacaaagagtttatagtctttctgatccagtgtgggggaaagaggtggaatgaaggaagctggggaccatgaaagaaatgctgtatctttggtgtgtagggtgccagggactttgtaaacctccagagctgggactccctccacacatttcatttttcccaacagtacattgtggtgtaatggaagttacagagcctcagtgccaagtggggagcaccacacaggggtgaaagtgggtgctgggcagtgaccctgaaccccccactagtgaatgacttgcccagacctggtttgaagcccatggccctggccctcactttagcatattacaatgttacaatatctctggtatcctgggttcttcacccatggttggagagtgaatatggactttgcagtttccaggatctcctatggggatcataaaagttgtgtggaacttatgaatccccaggggtctgaggtgaggccagggctgggctgggtcaccaggtgctgggtactggggactgagccataccttgtccaaggagatgtgggagatctggaaacgcagaatgatgacccagatgagtcccaggatgagtgtctggtctccgtccacgatgttctctggcccgatgagtggtactggcacctgtgggcacagttggatgggctaagccatgaagcccatgtccagagaggactcagtcaccaaaagcttagggggccagctgcgggatgggagcatcctggaatctatcctgccccagctgggagttccctcagggagaagcaggcaggggataagtccaggaaagcaaaggcttcctgcctggttggagccatggcctcaagcccacctgggtgaagccccaacctggtgaactgggctgggccctcagagcaggaggactccctgtgtgtgggctacaggtagacctgggccaagatcagtggttcagctgcagggtttggaaatgaggggtcataacagtcaatgtgtgagcccaacagacaatagcaactgtctgcctccatctcccagggtgtcctgggatcttcagggggtggctgggtccctgggctcacacccaaatctcagccctcttcttctgttccggctccaacagggccagctataaatccagactcccaggctccacccagtcagactgtcttgggccagagcctgggaatttgcacttgaacaacaccttgggtggctcttaggtacaccaaagttgagactcctctgccctacatcctgccatttggacagggaggatgggtgagtcaaggggagaagccctgcaggatctggcccccagccccctgtggctccatcttccaccctgtggaatcacatagctccaaggcccatgggattcttatagttccatgggattctaagcacaggacttcaggcctttgcagggccgtgcctgctgtctgaaagtattctcccaggtatctgcatggctattcacctccctgcctttaactcttcactcagatgttgcctagcctgaccactttatttaacacagaaacttaaggactatttctcccacccaaatacacactctcgatccccttgccctgctcaagtgaggatcttggctttgttttctggtgtatcctaggggagtggcacacagcaggcaatcgatcagtaagtactgaatggagaaagaaaaggagtgagactttccataagacctgaagggcaactggcttcagccggccactactagccctgtgggaggagctgcaatcctgggtgtccccctaggtaaactttggtatatctggctggcctctaaaggatcccacccatgctcctggggtggattccacctgccatgtcaatcaccttggcttagagttggagcctctggtgagtggggtgtttgtctgctcctcccagctcctgagagcctatcctcctgacttcctattgagcgatgtcacgctggtggcttaaactcaccgtgatggggggtattaacgccataggatcagcgaatacagcacactggagtttttatttcccccagagaatcatttgttaaacgtttaccagcacaccgctgatctgggttcaatgaatctgtctccctttgaagccaggtgccttgaggtgggggtctgggctttgcttagtggagcccagcgcctgcatagaatgcccagggcatgggagcatctccataagcgaatgcatccctcattctgccacacattccctgtgtgtttgcggcaactccgtcatcctttctagaccacagttgcctcctatgtgtatggagacaaggatgtcaccctcacaggtatcagtgacatgctgtatattaaagcttggggagagctgcaacacctctgacaaaggctgtggggcttacacccttccccagttcctggaggggagatgactggctcacagggtcattgtccctggatcaactagggcccagcattctgcagctggcagcgttctgctcttgcacctgctcaggacagcagtcactcccattccctttgcttgggcttctcccctccctggctttcctccaacacaccccaggaggctggatgtaagctccactccaggatatagtgataggcacgcacagtcaggctccatccagccaggcccagctcagtgacttcacagcctccagggacagccacctccaggagcccttggccttcacagttcccggtttccaatgatccctttgccccaccccacccctgcaccagcccctcaccctggccatgagggtccctctgtccctggagctccggcctccttttagtgcccatctccttagcctgtccctttctttcaggtgactctgcctccccccatttgctgaggcctcctccctccttctccaagacaggccctgctcctcttccccacctgccgtcttagtcccacatctgggctctgttggctggttaaccatcgatcttgcctggtaaataattcagggcctctgtttcctcatctgtgaaatgaaaagcctaagagaacgctaagattcttttggcctagaatcctgtgagtctctcttatgacagacagtgacattttccaccccagtagggacctggattgctactgccatggccagctgggtgctctccaagtcaggggtgctgtgcgaggagggcgtggcttctgctcctctgtgtcccagccactcctcctgtactcaggccccagctcctctgttctgcccagtggcctggcgcaggaaaggtgacccagtagttcagcctgtcccagctgcctgccccagcaccatcccagacccctttccctggggcccaccttggccctgaggaaggccagagctcggctgctgttctccaggaagtgcacacgcaggcggccccggctcgggggtggcagggcctcccctgagatgagctccagcagccgcaggaggtggatgccgtcagccagctctgtgtacaggttccggatcttgatgcccgcctggggaggggacaggggtaagtatggggtcagcccagcctcacctgtcctcccatcctgggacctgagaggtacgacccagagcagctgctttggaagaaggagctctggcctcagcttggcctcaggcagatgaccccacagctcaccccggaggcccactggccagagctgggggcctggtatgggtgggctgtgggtcacagctggctatactcacctggccgcactggaagacgttattgatccacttggtgaaagtcttctcctgcatctgcatgtgccgggcctgtagcttgcgaatgtggcccgtctcgtactgagagtccatggtgagacttggactgggcgggacccggagttctgtgctgggcctcctgctgcggtgccctgcagccccgaggagctcccggggactgtggggctgaccagccatcagccctgcagactttggggatgaggagctgctggatggctccctaaacctggagggcatgcagattaggggatgatgtgaatggagatggcccctctaccaggggcctggggtcccgccttgccagactgtcctcacatttcatgggggttgcagcttggagcccagccaggtaagggccagtgcttctggtcccctgtgcttgaatggcccagggccccctttgccccaccccaccttccagattcttcttctcagagcccctgctgccaggtccctccaccacagtgactgggacaggtggaaggaagacaggaaactgcttaccttggtgatgcctgggtcccacagagacggctctgctggacggatggagatggtagatagcaggggctgcttaccttggtgatgcctgggttccacagaggcggcccagctggacggatggagatggcagatagcaggggctgtggagggagggagagggacatcaggagaggccaaggctggagcagggctgcaccacagccctccccttgagccagcgtgctggggtgacggcacacaggcggcattgtcctcccacctgccacagggcgtggcccagacagggagggggtggttcaggaatgctccagggccattgccagatgatgtcctccttcatcatcctcccttccccgccagcaacttctccaactccaggtgggggtcctggctcccaggacgcagaggcccatggagcggccctgccaccgcatggggtgctgcagtctgcgtaggaggtaccaaagggcagagcctctgtgggaagcctgtggacgcacttcccaatctgagactgccctctgtaccctcttggggcctctctgtgagcacccagggcgaggggatgagggagcgtcctgggccgtggtcttctcattcacccccagggaacagcccatagactgagggcctcacagaccctgggcttggctttccaggccctgccagagtgcagcctgcctagcccggggctgaagggtaggctccctggaggaaggggtgacctggaactgcgagggctgtggagtctcctccaaaattagagacacggtgttaactctgggctccacagagctggccgtggcccggggctcggaggcaggggtgcagagggagctggtgggcgcccatcccttcctccccgagcagccgtggactacatgccagagtgaaggcgagttctaattctgggggtctcacccgcctctggctaaactcagggtagcagtgtgggctggggtgtgtgtgtgtgggtgtcttccagcggccctggagcctctgaagcgacagcccgctcctcagggaggcgctcctggcagccacagcccacagcaggacagccgctcagcgcgcccttgagagctgggctagggatgagtcacacttgaaccgcctgggcccactgcaggcagtcaggggtgacgctgagaggtgccgtggtctcgggtggggtgcggcttcctgcgtctgagagacgcttcctctcctgctgtcctctccctgccaggccccttctgcagcggctggcttccagacaccctgcgtccctcccttgctcgcagcagttgctgtggcggtcctcccgtgcacccccccttctgccctcactgcccctgggggtcctcatcacggaccccctaactcggcatcctggacaccaccaccccgcacctttccacagtgcagctctgctcgtgcctgtgaagcctcccacagcctgggaaggaaaatccagacttgccagaccttgcctcagccaggccttggaagcctgccagcttacctaaccaggctagtctgcccccctcactctgggtgctctccatgggccactcaccatttcctgagcaggaccagagctctcctgccccaaggctgggcttcagctgctctttcagctttgaacgtcctttcccattctccatcatccacattcacctatcctgcctgccccagttaaaatcctgtttcttctaggaagtccctcatcccacccgcttaccccagggagactgagcttgttccttctcctagtaagaccctcagcccatggagtcctgtgtgatgttgtgagcgtgggaggacagactgaactgctcggcccgtggagtcctgtgtgatgttgtgagcggggaggacagactgaactgcgtggtgcttcgcacatagacctcaacagggattggcattttgaagctgttggcgggggctgtggactgcttttcttcctttctagctcaacggcagctaaagccactgcatacaatgcaaggactggctcctgtttggccacgactgattgcagcccctggtgaaatgagaaccctgtgggtcggaacaaagtttggattatttatgttgcaagtaactaaaatctcaagtgaaactggtttaaacattatatttttattatttatttatttatatttaattcttttttagagacagggtcttcttaggttgcccaggctggtcttgaactcctggcctcaacgatcttcccacttcagcctcctgcattgctgggattataggtgtgagccaccatgcctggcttacacagtataaagggaatgcattggcccacacagtggaaaaaaatatctagtaggaataggaaggacttcaggtgaggtttgatccagcagctcaaatgttgtcaccacaggcctggattcctctggcctttctcaaggtctctttcattttcatgctccacaagatggcttctgccaggctgacctccctcccctgaccccagcagctctggacacccctctcagtgccatttatattgttgcatcaataggctcatttctatatactgcaaggttcagagaagacagagtatctctctcaagagttctaacataagtctgggggtcctggctctcataggcttgaacagggccacatgtccattcctgagccaatatttgtgaccaaggggatgtggtcaatctcatccaaacctcacttgaagtgagggtgggaggaggagtgctctgcaaggagactgtaggtctggaccaccaaaaaggtagatgggttggtgggaaaagccagatgcctactatggtagtgggcggggggagggcacactggcaaggtacagcaagaggcaggggcagtgctggacaggcaggggctcctccctagcacgactggagaaaggactcctgtgaagcggtcacctccatgagtccctcctgtcctggcttccaaccactctgaagtggggcttttgtccacagacctggcctctgctgcctaccctcttctgtccccacctgatggggccgctttccttctgaagcggctgcattttgggtttctctccacaggaagagttggggctcacaggcacaccctctccctaactcttctcccccggttcaacctggatccagggatccacactctgctccgagaggccagcacgcagccactggaaaatgagccagtgggagagggcagctccatgtttattgatcagcagactatgtctttttgtttgaaacttctaaataagattacaaaaagaaaaaaaatagaagcattgcgtattaactgcattggttaaccaacattggaacccaatactcttgtattaggcccgcatttacctgagtaaactcagtggttttctgtcctaagcatgcttgcctgctacatcccatggagaaaataaacagtgaaacactttcctcatcttcaaggcaattgtctcaggcatcctccaggcatcatgaaggagggtgagcgagggtgcgaggtggaaaggtccaggccgcggctgtgactcccgcgggtgaaccacagctccacagccccaaatccaaagatgctcttgctgcagcacgacaagtgttcaaaagagaaccaggcccagcccggagaaaggaaagccaaaagccaactgaatgaatgaccctcccccagaagagcaaccctgcccccaggccatccaagtgcggtgagttgagaaatgaattgacagacgctgcagggctggagcaggaggcggaagcaggttggaaggctgttgtgtgccacccctccctgggagctggggagattcccaagtcttagtgcagtgtttctctacaaacggggtcaggagaccctcactggcaggctgacaacttggaagcagactgtgggagcaataggctggagttttcattttccctttaaactcaagaccggaaggtttgtgttatgcgataccatatgctgtgtagaaaacagggcctcagcttcttagatgttgtagttctagagtttaggtacttccaccctctctcctatacataaacactctgtggaagaggttctttgaaaattggggtggtgcaggaagggcaacggtgatggtgagcaggccccagggtcggccctgccgccctgccgtgtggggtagggagacagctggtggtgtggacacattcacagaactttgtactggtcctgggaagatacaagtcctcacttggtcgccatccctcatattttctagtgttttcttttccagtcaacttttcttgatgaatgactgcatgtaagaggatattaagaaaagtggccaaatgatttcctttttttttcctttctctccaagaacattaccaggtgccagcagggaaaggactccgctgcctgacgcctctcccacctgagagcgcagaggtagggagatcacagtgcctgagaggttttcctccacggagaaatcagagacctcaacctgctgccctctaaagcagctttctgtatccagacaaaacttacatatgtacacgttgttttaaaacgacatactcatgtgacacacatgtatataaattcatgtttatatatgacaattgaggagagttaaagaacaagataattctggatggaaaaatcagtttgcctgggcatctgtaaacctttgggcaagtgaattccctcttctctctcagttcaccctttggtgacctccaccgtggctgcagacttcaggtggtcctcacgcattcacagaactgtctgcttaggttacagcactttgggaggccgaggtgggtagatcacgaggtcaggagatcgagaccatattgaccaacatggtaaaaccccatctctactaaaatacaaaaattagccgggcgtggtggcgggtgcctgtagtcccagctacttgggaggctgaggcaggggaatcacttgaacctgggaggcggaggttgcagtgaactgagattgcgccactgcactccagcctgggtgacagagacttcctctcaaaataaaaataaaaataataaaataataaatggttcttttctatgcgtctaatgaatttaagtgcttgttaagactaaaaaccatgttatgcatttcctgctcttaaaactaaattatgtagaaagtaagctagggagtgtaagggtaggcatctggatataaatgcttctcccaaatcaagattttctcttcaatctgtgcctttgaccctgtcaccaaaggcaggtgacagaaaaaaaaaattatgtgccttttggaagactcagtgggacggttctgatttcattcacttctggtgccagcaggcccccataccatgtggccattgctgtttcgtgtctcttcctgcataaataatgcagagaggccatgcaggtatgcaattttctggagatgaggcagggagatttgcaaggaaaagtcacctacctccccaagctggtgcccacagagggggaggcacctccacctgacgcaggtgtctgagcagcagtccagagaggtttactcaggggatttggggagcgcacactctggagcagaagtacaggtatgtgcccgaatcctgcctcgtgatgggcattcatgatacgaaccacacagcctttaaagaaaaggttttatatgaaaggttccattttgtttctgtataaaggcttttatcctgtaaggaaaaaaaaaaaacacaaaaccctagacataataaatgcctgttttctacaaaaacaatgtctaactctgggtggactgatctcttctcaacagcccagggcagggctggtccctcattcacctgtgtccacagggccgaagacactgcacacactaggacaggatttgattgaatttaaatcctgccacccaccaaggagacctcgggatatttaatgtttgagggccacactaaacgatcactgcagagaaccacctcttttctttactgtagtttaagtatgataagtgggctttgctattacttattggaaaaaccagtaagaaaagctaattttcaggcttcaatgtgatttgacatgcaaacgggaagttttgccaggggttaataaaggttgtgaattccaaattcctagccgaatatggctttgctggtaagccccctggaagggaggttgggagggctgaccagatggtcatcggggcactgggatggaggcacgctggggcctgactgcctgctctgctggagactgcagaatggatggcagatccacagtgcatcccccttccaaacccaggaggcatctgtcgccttctctttggtagacagtctggagacagcagaaaccctctgctctatttttttgccactctaaatatagcagaaaacaaaataaaataaataagataatctttgctgcctccaggtgccctctgagggacagacagctgctccagagttgttcatgaggacaaaaagcccaggcagcctggagacccagctgctctgggtgagccttagctcacttcctgtggttcctgggacttaccaggcccacccccatgcgcatttctccaggcaggttctgaggactctttggacaatttctctttcttctcaacccttcaatctcctaatccacccccctacccccaatattttcatagaaactaagggaattttggaggtgaaagaagtcatctagtttccagtgtccaccctccccattctacagatggggaaaccaaggcacagagagggcagtgccttgcccaaggtcattcggtgagtcagtggtggagcaggcctgaggcccaggtcccccagttcccaccccgttctgcagcccacccctcagtcggccttgggcagggacttcctgtgcgaggggggcacgaggtgggggggcaggctgctgggcagctcgtagccgtcgagcttgatcttgatgaggtgcttggccagcgcgaactcctcctcatcaagcatgccgtcgcagtcgcagtcggccagcttccagatcttgcccaggacgctgttgggcagcttggaggtcaccatctccttcttggcgttgacacctgatatcttgccattgatgggcgacagagtgtagaagagctcgtcgtagacgggcttgtctttggccacgacccactcctcctcgtcggcgccctccttggcaccctccccgtagccctggttgaaggggccctcggtggtgccatcgaaggcgccgccctgcaccagctgcgtgggcgtgctcgtctcctcctggctgatgaggttcatgaggggcgagatcttgttgctcagcatgttgtccactgcctcgatcagcttgggcttcagcgagtggaatttggtgaagtcatagttctcaagctgttcctgcagaaggacaaaccacaggatgggttacatgtggtctcttcagggggaaacagttgggggccactggagggagactaattctgccccaggcagacgtcccacccactactcaggagtgcactctttgggagcttcccacatccagatgtaccacatataggagtggttgttttggaacaagaaacaagtgtttttcctatggcagccaatctctgctggtggccgcatgagcgacagcaacctccgaggactctgagaaaccttctttcacctgcctttttaaaaatgctctagagttagtattctatttctcaagggatttcactacacacttcagccgatcttcatagcaatcctgggaggaaggaggggcaggcatttagaaccacattttacagagagctgtgaggggctgtctggcagagtcaaagcagagcccctgtctcctggctcttgactaatgctctctgtgctggaacacagagctgtgacagaaggactatgtttacataaaacaactaattaaataccttgttttcggaacacgtaaaaaaatgtagtgtaggacagcttcttagtggctctaacctcttatgaatgagctgagggcgctactcaacaggaaccccgtaggaccagccccaccaagtacggcctgaccaggggcacctgtgctaccccaggaaggtatcgaggcagggccacggagaccttgcatatacaacataatcatcatgaatccactgtcatttctaaaatatggacaaataagcaaaagctggaacttgtaagagcagggagtagggctggggagcacgagggaataaacgtagctggtaagcctgagtatcactggccaggtcaggacatatcttagctctacctgttgagtgaggcagcctgtcagcagacagagcagcagaagcacaggctctagagggggcctgggaaacactgtgactgcccaaccaggctggggcagactacaggatgccacagaggctctgtggatggcaccgtagaaactgaccttcctaccttggttctccttggttactccatccatccatccatccatccatccatccatccatccatccatccatccaacaacccacctgtccaactaatcctccaactaaccatccatccattcaaccaaccctccatccatccattcagccaacaattcatccatccatccacctacccgaccaacttttatttgtcatttactctgcaccagcccctgttctggggcttggggatacagaataaatatgaaaagccataattcctgctttaaatgagcttatgttgtaatggaggaaggatactccaattgtttaaaaaaggacttgacataacacagtgaaaaggataacatgaaatctataaagtcattagaaagaaaaaagccaagtcattaaaagggagagaggggccaggctcagtggctcacacctgtaatcccagcactttgggaggtcaaggtgggaagactgcttgagcccaggagttcaagaccagcctggtcattagacccatatatatatatatacatatgtatgtgtatacatatatgtatgtgtgtatatatatgtatgtgtatatatatgtatgtgtatatatatgtatgtatatatatacatatgtatatatatatgttagggagaggaagggaataatcacatcagatggctaaggttaaggaaaactaccgcctgtataaggagaagagctcagttgcccagggggacccctggggaccctcactgtctaaggagagaaaacacttgtttattgcaagagacaaactttctgtggctctgaactgcgagagttacctagagctttacatgacaggcttcaaagatctgatgaaaagtgtcttcaacagtagttttattaaataaatgcagaaatgttccaggtatggcaggttttatatgtgaagtatttctgtatgtacagttctagagggggccaaagagaggccatgcaggtgtgcaattttctggagatgaggcagggagatttgcaaggaaaagtcagacctcgctgttttggacagaagcaatgtgacaggctgctaggaaaaaaaaaaaaaaacttggtgttatcataaatatcatgctttcttgtaaaaaaaaaaaacagaaaaaactggtaagcaaaactaaaaatttaaaataatttataatctcatcatctggcaaaaacctctgctagcatatctgggcatgcatttctagccattaacatacatacacacacacacacacacacacacacacacacacacactgaaacaataccacactcttaacaaataatatgtcatatatttctgtggtattaatttttacataacctttctcttaacagttacagaatattgaacttagactgtagagctgggccattcttaattaaccctgtcccctatagctggacacacaggttgtttccaatagagaatcaaaatcatggtctctagggtggcagggcaggaattctgggctgacatttggaaggggattcctgggtggtagttggtggggggacagagctgagaaatatcagctaaacgggctgacatttctctagggaagggactctgacatattctcaggaagtaaagtcagcagccatcaaaccatgcaaacccagcgtgtggcccctgctcagctcagagcagcgggtactgcaggccgggtctctcaaacgcagtcactagcatgtcactcctgacatcagcaccaaacaatgcggcctgcacttcgggctcctgccaccaacatctcaatgggccaaggagatggaaaagagaacgctaagcaggtggaggagcaggcgtcccccacaaaaatcccagtgctgctgggtcaacgagtttggattccccgggtgcgtgaacacctaccccatttccttaagaatgagcctgcgctcagagcgcacacagagcccctgtgtctggcccagcagacaaaggagggtgatgcctgcccaaacttcccaccagcctgcaggggccgtggattccgactgcagagctctggaaaactggcagggggagtggccgcatatttgcaggggtggacaggaggcagcagttattcctgtcctgggaggcaggcaagaaataaaccctccattctcatccctgtggtcccccccaggcttgaccggggactgcgggggcaccagttaaaccatcatcatgtcactcctgacatcagcaccaaaccatcatcatccctgccctctgccacggtgagtccaaaacagttcttattgggatgaatacacactggggaacttaaaggtatttgcccatcaacagttgtatccactaagccaggaccctggaattgctccctctcaagaggcaaaggtcagttcccagccccgtctctggtggggctgtcccttgcccattaattgccaacattaaccagaagagttttcaaatccaccagagggtctgagcagatggggctgactctgctgccctctgctgttgaaatgctgccaactcatgagctgaggggtccaaattctccttccagtcagaggagcagagtcagcagtaacggtggcccttcgggtgctcatcttgtcctgcagtattaacactgtgctgtcagtcacggtccctccccagagcgtgccaggcacgcacaggcagccacacaggtgggttgcagggcctgtcccagctcagggaagggccttcagaatacactctcctctcactgctacagctaagagtcactctgaccagctggctccatgagagaacagggagaataacaacctaaagctggcatcagcgagctctctgcgtgaccctgatatgtgcaaagatcacagtgtggtcacttctaagcgtatgtcccccctctgtcaaggcctatgttacagaggatgttagactttaacagcctcagggatgggacaggccctaacccacacacgcgcccctcaaagcttccggtgacagcaagctagcttgcagtatcaggtgacactaagcattcctgacaggctccaggctgccttgttccttggggattctccgaaggaatggggtgatgtgactgggcctcagcctacttcccaaggaggcctcttcctgcagcttctaggggttggcacggggaacccctggtctataagccctgtgggaatcgaggctgcgtcagggcctgagagcctgctgtgatatggccttacactaacttactaattcacttggcttgtgtgaattgagcactcaccacgtcctagatgctggggatatggcagtgaacagggcatgggtcactgacctcatggagccacagacttacgtgggagagagatactaaatatcagacatcagataattcaattacatggaagcacaacagtgctcatattgtaacaagaaacatgtgtccttacagtggggttgctgtcaattatttttacccccatttgttcattttttctgttttttgacagggtctcctctgtcgcccaggctggagtgcagtggcgtgatcatggctcatagcagcctcgacctccgggcttaagccatcctcccacctcaccctctcaactggctgggaacacaggcatgagccaaccacacctggctaattttaaaatattttaatggatatcgggtcccactatgttgcccaggttgttctccaacccctggactcaagcagtcctcccatttcagactcccaaagtgctgggattacaggcgtaagccactatgtccagcctcatttgttcatttttttgtgttgatttattccaggggcctagaacagtgatagcagcaggaggcagaaaaatgctgaggcagataggggtgggtctccagtgaaaccctatcttcaagccaaaggcagtttaaagcctgcaggccaagctacaagtcaaatccatggactggattgagaacctgtctttccatttggctgcttttctttgattgatcctcacccttcacctattttacatatacctacccttccctaattgtttttacactgttatgtccacctttgactggtgcctttgttttaaccttttttgcatactcacaaatcaatcagcatgcactcctctatcctgtgcctataaaaaccccagactcagccacactggggagatgacctgacttcaggagagacaacccaatcttcccatcccctcttcactgagagttgttttgttgctcagtaaaatcctccaccctcatcactcttcaattgtcagcatgaccttattcttcttggatgcaggacaaaagcttgggacccaccaaacgcaggtacccagaaaggctgtaacactggccctctgccctcaccattgcagggtagccgtgccactcaacagaagcagtggtggggtcgagctggaccggagccatgggccagagtggggcaagagggtgactgagctgctaacatgatgcacaactaaaagagctaattagcacactgtagcaccccctctggggctttggggttgcgggcatccctgcctgggcactgccacgttccccttggggtgacacacctggtctggctgcagaccatgcacagagcctgctcctatgtcagcacttggagtggctggctggatcctgcacttgcttgctcacccaccttccgtggtgctaaggtactgggcatagacctgagtccaggtgattctcagcaaaggcttggccctccttgtaccctccatctcagtgggccatggctgctcctgagatcatgctttccttgttgccttcccccagctcagaggaccctgggtgtcttctgacctggccagcccaggctagctttgtcatgagtagctctggtcccagagcctgctccctacattatcgggctcacaggggaccagcaggagaggcctggcaagggaggcctctgtggagccccagggctcaagagcagcgtctccctgtggcaaggcactgtagcaacttcaggaagccagcgaggcacagaggccccaactgggccacagctcaggctctgtatttctttataactttcatttaggtcaagaaaccaagttcccttctgaaatatctgaagggtacaaggaaacagctgtcttactccttggtcatgggatacagggcataaccaggggtgtgaatggggaagttgcccagggagactgctcctggaggccacaacagccctccaataccacctggtgaccagaaaaacccaattcagcttgtgagcacaggaatacccatttcactgctggaagaaaagagacatttctctgttgtgtgtgcgtgtatatatttttttgagacggggtcttacactgttgtcctggctggagtgcagtggtgcgatcttggctcactgcaaccttcacctccagggctcaagtaatcctcctacctcagcctcccgggtagctggaactacagacatgcaccaccacacctggccaatttttttggattttctgcagagacggggtttcactacgttgcacaggctggtctcttgactcctaagctcaagtgatctgtccgccttggcctcccaaagtgtagggattacaggtgtgagccactgcgcccaggctctgtgtgtgtgtgtgtgtgtgtgtgtgtgtgtgtgtgtgtgtgtgtgtatatatttatttattttttgagatggggtctgcctgtgtcacccaggctggagtacagcagtgcgatctcagttcactgcaacctctgcctcccaggttcaacaaattctcctgcctcagcctccaaagtagctgtgattatagccaccacacccggctaatttttgtatttttagtagagacagggttttaccatgttggccaggctggtcttgaactcctgacctcaggtgatctgcctgcatccgcctcccaaagtgctgagattacaggcatgagccatcacacccggccctctgaatatattttaaaataaatacagctaaagcatattgggtcagatcaaatatattagactgattcactctgaatccaggtgtaaagagctgtcatcaaaacagcaagaaaaacccacctctgagttagtgtataatttatataaagcttgcattaaaaaaccccttaggatcaaagttcccctctcatcacctgctggcccttgcctcttctgcccgaccttcccttctccctgtatcctctctgctttcacctttccctcctcctgcctcgggctgtacctgcttgcagtttttaatctatgctggcttcaatgctgtcactctgtggctcaaggcaaaagatggtaactggtggtctctgtgtgcagcccatatgcaggtgggctttgtttgtcctacatagtatttttttgagcctaaatgtgaaaatcaggtgatctgacatacaaatccagatttccagcttctcttgagccttccaggtctgtagtcccacaaggcagtgaccactgggctagacggggcttctgcattgtccaatctgccctgccatgagacccctgacatgttcttagcacacctcgggatggttttcttccttgctgacacatgtttcttggaaccttcttctctatcaaacgtgggaaaaccaaaggcagccagagagggtgacagagtttctctttcgcctggcctgctccactgtttgcgttactgggtggtggctgcaggcatctgagtttgtggctcctgctttacagagaggactgtggcccccagggcagaggggtccttgcagcagataagaagacggccagcctggctctgtgaggactgtcagcccagaagccagatgggtggcctcgcttgtgaggacacgctcgtctaacagcagtgcagagaggtagatatgccggtcagggcaggacggctgaatgcagcacccattgttgcctggctggagctgcccagccacaactcaagagaggccttgacagcaggccaatggctgcccagcaccagcctttaagcacagtcctccctgtgcccacgcagtccagcagcgtccgcagagccccacagcccctgctggagcccttgagcctgcagcagcaaggctgcctgagcacataatcccacggcgtgaggcaggtcagggcagggctggaggaggccgcccaaggtgaccctgaaggccactcccagctgtgattccctcacagttctgggattccaatgtcaccgcaacatcaaccagcctccttggacacagtctaagagggctgctcacctgactttctcatgggagcttcatttacctttggccatgtgtttcctttgtttacgcattttggaagacaggcaatttctgctttattcatagcctattatcatggatcaccattaggaagatgcgttgtccttgatcctaaaccatgggactctcatttgtctccagcaaacagccagacaatgtggcactgcacctctgccctctgcccgtgacattgtagtgggctcccagtacctgcatagccttgacctcagggaagtcccctgcagaaatctggtattctcgctgtagctgaatgtagatttccggtagcctgctgataagctctctcttcttgttttcctttccaaatacacttggcatctccttcttcaggtagctgatgatgtaggcatgcacctggaggggtatagatcaggcagggaagtgtcatttagaattgcatcagagaaggaacaaacaagattgcatcttaactccatcataacacataacaggtacccacacaaaccaggtcccaaggacaggaggaggggagggtccagggggagtggagctgtccaagggtggccggaatgtggccagacttggggaaattctacggctactgttctgttgtgcctctgagtggcaattctggtgtctgtagggagtgagtggtatgggtggggcctgggtgggagagctcttagttctggcaattaaccagaatacccaggagaaagtttcaccaggctggtgcctgggagcaacaggaaatgaaactggaggctggcatcaatggctgatcaacatggaaatctgtacccagtgaacgatgagatgagaatccccataacccccctgttatgggaggtttagactctgagatctctacaggtggaattaaagtcattctgcacaagaccagctgcctgggatcaggctggatggcagaagatccccctgggagaggagcccagaagccccagaaaccttgatcactggggcttggggtagccagcaggctgtcattggaggggcgagaatctggcctcaacatttccactcttctactgatttccaacttcaggatattaagaaatgttcactacaaaagttctctttgtatatatatatttttgagatggaatctcgctctgttgcccaggctggagtggaacagcgtgatcttggctcactgcaacctccacctcctggttcaagcgattttcctgcttcagcctcccgagtagctgggattacaggtgtgcaccaccacgcctggctaatttttgtatttttagtagagacggggtttcaccatgttggccaggctggtctcgaactcctgacctcaggtgatccacccaccttggcctcccaaagtgctgggattacaggcatgaaccaccatgcccggctactttgtatatcttgaacttcagagtaattgtgaagtcaagtaagtaactaaaataagaaaggatgaaaaacagagtggtgattacaaaaagaaaatgactatgtagcaacggaaaatcctattaaagaaaacagacttctactgtaatcttgtagaagttgaaattaaataaagggggtaagcagatacattccatagctcagctgagggcccgtgtgtggacacatgctggacacagccaaaaacattttgtgaggatttggatgctaacctaagtacctaatgcaaggtctgacatgctgaggtcagacaatgtcaacttcccatctgcacaagggtcgtttaacagaagcatgcactgtgcagcctggctaccgctgagaggatggtcttggagagatgacgctaaacctttctgtcaccagcaaacttgtttatgtacttatttttcaaatgaagacaattgaaatgatttacaagattcttagagataacttgagaaacccgaagtttgggatccgttatttagaatcctgggctttaaccgctgtgatgagcaagtggtaagataccaactcctttgcctccgacagtgaatgcctggcttggtgtgggtgggctggggagggccagggctgagggagcacccttggactggaggagctgccacgttccatcagggagaaccagctgctcaccagctgtccttgcatcatttccttggcctccaccttcctggaaattctggattgggcctatgagtatgttctctatgtatacctatgtatacctctctcttctgtgctcaggctcaccccaccctggagccaccccaagggaagcaggaggcccccacagctgctcagtctcccaaacacaagggcttcttattgagaccacccccttccctgctctggggcctagccctggagcagctgcctaggcctctgtagggcttcccaagagccctcaccacgtactagtaaggtacctctgagccgccaggccccagctcagggagggcttagttcccgctcatctggctgactcctcacccactccctgccgcccaccccccgaggttgggcacactgttcctgaacactccctggtgcccagggcctgctttacctgcactgaactcagctgatgtgcacctgccacacccttcacccactgagtgtcacctgatccctcgtctcaggcctcatggtgtttgctggctgatgaccgaggtggccccgacactaggccttcacagccctgataaacctggggctgatcttgtgccaggtctcaactccctcctccttccgccagcttggtgccacctgagtcatgacccttaggtgacctgctcacactgcagctgctctcggtcccagcctccacttctaggaagttctgttagcgaggtttgtggaagtctcctgttacgctgcctctgcatgtccacccgcgtcctgcccttcctggtgcgccctaaacaataacccagggccaacttctgtgcacagacctgctttcagaagttcatcaagttggccaggcacgatggctcatgcctgtaatcccagcactttgggaggctgaggcaggtgggtcacttaaggtcaggagtttgagactagcctggccaatgtggtgaaaccctgtctctactaaaaatacaaaaattagctgggtgtggtggtgtgctcctatagtctcagctactcgggaggctgaagcaggagaatagcttgaacccgggaggcagaggtcacagtgagctgagattgccccactgcactccagcctgggtgacacagcaagaatccatctcaaaaaaagaaaaaaaaattcatcaagtcacaaggtaaattataatccttagcatcatgaaatactgaatctggaagtgaccccccaatatctactttaattcctggttccaggacatccatgtgactcactcaaggtcatacagctagttggtagatacagagctggcactagcatccaagtgcctcgttcctgtccctaaagaactaatgactccctgtgggtatgccctgtgggtatgcattaataatcttactgaagttgttcaaaatctggaattcaaaatgaactgtgtcccatagaatgagtctggaaaactttgatctgaggtttgacttctgctcgtgcctaattcactgagaggctttggaagggtcctttattctccctttccccacacatcaaacacggacacaatgatggcacacaaacgtcgggacaccacgtgggaatgcgggtgaagactgcgagctgctggcaggatggcatcctgtcattttctaaagtcttctggtaaacagacgggacagcttgaatgactaaaatccacagtcagcctccagagatcactcctgcaattatgtgtcaaaggtgtctccaaatacatgccagacccagggccagacctggtggttgtccctggggaaggaggtggaaacacttgggtcttctgacctttataatgagagaaaactaattgggaagaggaggagtacgaaagagaagagggggactagacctggagcttgaagatgaggctcaggccccgtgaccactgcctacccactgagcaacttggggccaggcatggcatctccacctcagcgtgctcatccacaaattagaaatgacaacaacattcatctcacagagttattatgagaataaaagaggtcatgtatttgaatgcactctgctcactagaaagaggagcaaatgttaacttgttatcaactaatggccaaagaccaacagctggaggtacagtaatgagagagagggctcccggctggttactccttaccaaataattaataaactctctctatttaaatagtaatataatgaatttgggttccaagtgtttaatttacattgacccctgggggcttttgaacattcgtatcttgttcaagtcatcctttgccttgtgtaaacttgcagaagccctaaggcatctaatggggatgactgggggaaatcaaatggatcaaaatgacaaaatgacaatttttctctaggctaataactcaatgagcagaaaggaaagtccttccttttaaatgtatatgaatgtatatgtagttcacacgtacactctgacacagatctcattgtgtccaatgatgtgtgtgtgtgtgtgtgcctccaagactgagacacatgtactaaagagtgatactggccacatctactctgggcttggagggtaacttcagcgagtgctggatgctggaagcgaccagtgctggaatgaaaagcttcatggaatgtgaggatcaggcagtagtttggggaaggcgggctgggaaggcatggtgacacactgtgccacgctcatctgcaaacttaacgcaacctgctggagacctgcggctggaagcccagctctggaaacctgcatagagtatttaaagccagggtatcagcacgtttataaagtgggtttatgataatataaaaaattcagttaataagcctgagacccaaaagatgaacccatggggtaacaagagtgtgagactgtgagaggcagagaagggcagctgacttgagcaagggtttgttattctgctcagatcaaaactggcaccaatggcacgtgtaattccgtgcagccttaaaggggaccggagggggctgcacacttgtctgaggtcaaccttcaaagagacaggcttccatttatgggctcaagcactgacacacacacatccacagtagctcagggctgctgactgagttatttttagagccctgccgaggactaggcaataccaggatcttcatgatccattatatcatgattctcacacgctttagcctgaatccatttggtgcacaaaaaatgcctcatttctttacaggagaattttttttttttttttttgaaatggagtcttgctttgtcgcccaggctggagtgcagtggcacgatcctggttgactgcaacctccaactcttgggttcaagtgattctcctgcctcagcctcctgagtagccaggattacaggcgcccacctccacgcccagctaatttttgtattttttgtaatttttttgtaattttttttgtaatttttgtatccagcacttgctgaagttaccctccaagcccagagtagatgtggccagtatcactctttagtacatgtgtctcagtcttggagacacacacacacacacacacacacacatcattggacacaatgagatctgtgtcagagtgtaagtgtgaactacatatacattcatatacatttaaaagggaggactttcctttctgctcattgagttattagcctagagaaaaactgtcattttgtcattttgatgacatttagtagagacggggtttcaccatgttagccaggctggtctcgaactcctgacctcaagtgatctgcccgccttggtttcctgaagtgttgggattacaggtgtgagccaccgtgcccagcctatagacaagaaagccaggctgtgcacatcacatgtgactgagaagagtctacatttgaaagaataagctaaattccacagaactacagtgaaccttgaaaatcactgacctctcctcttctttctcagttttacttgtttcttcctcaaatgttgcctcatttttgttgagcaaagatctccaaatgggtgacagcctttcctattcttgggcaatacgcttctaaagggtggggtctgatagtgaacttgcattgtttgggatttgtatgagtctaatttctttaatttggctattttaattatagctgaataaaagtaaatgacatgttccaaacccttttttgggctttcccaaaacagcttcctttaaagaatcatgaaatgaaccctgattggcatctcagagtgtgagccgtcttccaagaaggatgtctactgagattgtaagaagtgatctttgaggctaaccaaaaacccactctaaagtttccctgttccttaaatacagagatgtgaaaaaaatatacaaacagaaaaagaagggaaataaacttcaagagctctttgggaagagtatctatctacttttcatattattaaaatgtcacctttatgacacttcgagtttgattaaaacggcgcacttgctttatctggatgggccatgaatcctggttaattatggtgttctataaataaacatactccacaacccaactcagacttgacatctcttagctgacatctgaaaacttaccctttgcatgttttcaaagtgtcagcttgataaacctaaactttgtagggtttctgtggatggagacttttatggaataaatagattaacagatcagtgcagaaaacaaggacacagggaggaggtactgtagctgctgttcactcccgatttcaggtgactgctttctggactgaggtgtcacactgaccgaggtttgaacgtatactttgcagcttacaggctgtgaagcctcggggacataacttcacctttctgagcttccgttccctcaggtgggaaatgaggacaaaaatgcccaactgtgtagttgtcaacaggatcaaacaaaaaaacacacataatgcagactacagagctttggaacagttggtgtgaaaaaggaaaactggatcaagagaaaggttaataaaccaaaataaaagcacttttggaaaatataaacactccaaaaagaaaaactcaggtaagcatctgtccatttaagcagaaacaagttcagcggtggaacatgaaactgcaggtggcgtgaggtcaatgtcatgagttagtggccaaggccgccgtgctgagtccggcttctcctccgggtgagcccgcttcctgtccccgttcctcagcatggcactgcccacgagcaactggcactgagaagctccggctgcaaatacccatacttcaaacattttcctttgtgaaaaggaacaagccagatactattcttaggaagaaaaaaaccacaagcctttttcctgcaagtaagctcagcaagtttgaccgtcccccactccctgcatccacacaagggttttcattattcacagtgtcagaatacagagcagcgttctgtgcctccaaacccaggccgcgctggcccgttcagagggcccgaggctcaaggatggcagggaagctctacgggttaaggcgcttggcatttccagcgagctttctgctccttatttatttatttatttatttatttatttatttatttatttgagacagagtctcactctgtcgcctaggctggagtgcagtggcacgatcttggctcactgcaacctccacctcctgggttcaagcgattctcctgcctcagcctcctgagtagctgggattacaggtgcctgccaccatgcctggctaatttttgtatttttagtagagacggggtttcaatatgttggccagactggccttgaactcctgactttgtgatccacccgcctccgactcccaaagtgctgggattacaggcgtaagccaccgtgcccggcctccttatttatttatatgactgaatacagcagcatctccagtcactgggtcttcatttaccaataactggtaaatgaagaatgtccatgagcatttaaaaatagttttaaaaaatctcaaaatctgcaaaggctatgacatgagtcaccaactttggttataaactaatgtggggtgtcacacaccttgaaggttgttcagttgtacctgctggagaaaggaaacaccacaaaccaagggatcaccgagtggaaaaacagccttcctgctaccaagcattaggcccaggacaagggcgagggcaaaatcatttcaggagagctgcacgtaagtggatttacaaactagttagcacatctgccttgcagaactggagcaaaaatggcttgtagctctggaaaggaagccacttggaccaggaagaacagataaagaaggatgactcacacaagcaccacaccactgcaggttagctgagccatatgggaggaatgcatgcacacgcactgggacacacgtgacagagagggacacaggacatcgaggtcctgtgtgaggggcagcagcagccaggacggtgtttgttttcacccaggcaagaggctgcccagtgagcacactggcacgaggacaggctgctaatgagcagcaagaaggaggaagaattgtccccaccttggctgtccccatcagggaagccctccctgcctcctggccaggcacgtagtcacccttcccagagcactcatggcagcatccataccatgactggcacatagccaatcacccagggagctttacacacacacacacacacacacacacgcgcatgtttacacacatgcatattcacacaaggccatgtgtgcacgcacacccctatatccgaggctctggggcagggcctgggaatgtatgttgcttctgatgatcagccaggtttgaacttcactaggactagataaaactctaaaggcacttccagcattagaggacaatgattttatgaaacatgcacatattttttaaagagccatttttttctctgtattttctcttggaggagggatatgcttttctctctttggagacatgaattgactctgtcacttgagggatgtcagcaggtcacctctcactgccccattgggcacacactcctggggctgctgaaaggctcagctatgaggcaggcgagccaggagcccaggcatgcaggctaacagcccgcagcccagaatgaggatgcgggggtgacccaaaaccagcacactccaagagtaagactgagccatacttcttcccagggctcccctggatccaggtggtaacactggcctttggtgcacggggactagcagtggcctctcagcatcctgttggtctcaccaatgccacctctttcaggtttggttggttatattcctatcgtcctgacatcctaacagctaccatgtagtgggtgcactgattgatccccctccctgtgcaccaggcactatgccaagtgctctgtcacactgaccaactgtcaccccaagttcttgtgaagtgctcttattagctccatggtacagattggagaacagggttagtcatctgcccaggagtgcagagccaggagctagggtgtcagcagggccacctgacctcgaggctgtattcttaacctagcgcatgttcattccttaagccttctggaacgaagcctcctcccacccatcttgcctctggagaggagacagcagagtcccagcccctggcctctgtgcaaggcatctcctggcttaccttggccagcctcgctcgcttgatgaggtcgttgagcttgcgcaccgctgccttctgggggaggctctggatgtctctaaagaggtcctgggcctcagcctcgaagagccggcggttgtccgtgttctgcaggggctgcgcccagaaggagccaatgtagacgcgcagtacctcgggcgtgttgatgaccttgcctagggaccacatgagggccccgtagacccgcatcagctgctgcgtgtccacttggtcggccttgttcagcacgacacggatcttgtcgtcctggccccggaaggccttgatggcctctgagaattcatctgagatgtccagcttgtgagcgtcaaagagcaggatgatcctgtccaccctctcggcaaaccactgcaggacctggcagaagtcatagcctgggtggagagaaggacacgtcagtgtagccactgctgcaggagacacgtttaatgggcggctcaggaacagtctcgctctccagcagctgccagggagagagccctgtctccaacctggaggcagtggaggcctggtgacatgaaaatcacgggctggatgaatccgggtgggaaggacctggggagcccttccacaggaggagggaggaaagagaatggggctcatggtcactttgggaattgctgactttcatatctgcgatttcatttagtcctcatgagtgttttatttcacctaatacagaccttttgcttgatggcagaattgatcaatggttttataaaaacacaggccatgggtcaaaagatcttacttctgaaaagtctcacttttctgaaagccccaaatacagaagaaagagaaccagaggccacctggcatcccatgggggtatccagtaagcataacagaagaggcatcgccttcaattaacccaagtttgtagagtgctgaggaggtcaaaggttggcccagccagtgttgtgatcaatatttatctttggactatttataactcaggtatattgtgaatatttttttaacattacgtatcacagccattgtgtaaaatggtctcttgccaatttctttttttaaaatggcctggcccacagcaaattctgtccagcctattctgaccacctccacaaatcatgcagctgcataaacactcttcagcccaaggtcaaggctctcaggcctttccccagggaggcagattcccacgaaaagcaaacaagaggaggccaagcccacaaagttgacttttaatctcagtctgactagttgcagaagcagagtctcaatccagcccagctagtgctgagatgtcacctgcctgacccccatgctaggggtcgtctcccctcttcttttagattttgaaaactttcaaacatacataaacatctgtaagtcatataatgaatgctgatgtacctaccacataattttaacaaatgttgacactttgctttgtttgctatttcagatatgttttaaaaccaagtatcgtttctttagataacaaaataccatacggtggtgagaaggaactagatcttcacttgtcaacacaggtaaatctccagaaaagaacaagagtaaaagcttagtttcaaaaggacatatacagcatgataacattcatgtaaaatgttaaaatacaaaatactcaaccatctgtggatacagactatagcacaaatacaaaaatgtcaacatcgattgtgagaccctggttggctgtgggggtggagaaggtgtgaatccaaggcagaggaaaaagtatctgaggtgaataatctattaggtgaaaataaagagggtctgcggactaaggtttccatgcatttgaagaacaggtgttagaggaatagctgaacaagcaaactggattcaggtccatttttcataaagaaaacaagacagttggtaacgctgaagccccctgtgcacccctccctgagcccttccccccactagcaggccgctgtcctgagtgtggtgtttatgccgccacacgcgtggatacttccagttcatgcttttcatttctctgttctgtctcactgcggcactccctgactccttggggataaggaagacaaaggcagttctcggaatgtgggccagagtttattttcattgctgtcagcagccagtttaggtcagaggaatatcaaagacctactgacagggtcacacatagtcaaggtttcactctgagttctgtccctgaaaggccagaacaaactgcctcctagggtaacactaagtgctactgccatttgagacagacgtgtgcacagacagccctagctcacaggattgtaggtccccagcggatgaatgaactggctgtttgctgggtgccgggaagatgctttggagccacccatagatggacctgcatggggacttgcttttccaggagagatgattgattcaccatgctgacctgaccactctcccacgtggtcttcctagtgatcagatggggtatctgaaggttcagaaacagatcaaagaaaacgctgtgcacatggagtgaatgtgagttgcttttgctgaatacccttcctgttgggtcaggaggtatcctttatgggttgtggaggctgaaggtgtggcagagagtccctcgccccattccttagcaagctggggcataagcatgtgatctagagttagacattcacttccttccaccagagaggagtgctgaaccttggggaaatgacacgaagacacagtgaaaataagaatttactcatggtggtggcggcttcctaactcttttctaagcctagttctccaactttcccattaatcctgtgacaaattctccaaaacattttcttttctgcttaaattagttagaatcagcttctttggtttgctattgaaagtgatgataaggctgggcacggtggctaatgcctgtaattccagcactctgggaggcagaggcgggaggattgtttgaggctaggagtttgaaaccacctggcaatatggtgagaccctgtctctacaaaaaataaaaacaaattaactgggtgtggtggcgtatgcatgtgggctcagctacttgggaggctgaggcaggaagatcacttgaggccaggagtttgaggcagtgagccatggacccaccactatactccagcctgggtgagagagtgagaccctgtcacaaaaacaaaacaaaacaaaacaaacaaaaccacaattggtaaacaatcctcccctcacccccatttaagatttcggaatacctcttactgtcggttccgaaagaaacctgccacccaaactgaaacacagctgctgctgctagctgcgctcgcgccaaccctgccgtgcttgtgccaacccagccgtgcagatgcagtctctcttcctcccagggccgcctgggttgaatggttacctttgattgcaacacttgtgtttaaactttaacttaaatttgagttcctaacagttaatttaagcatctttaaaaaagatgccatttcaatgctatagtgaaatcaaaagttattaggaacagagctgccagatttaagtttactataagtgacgccaatactcatgtctggaggaacaggtacatatccatattttcttgtgttaaagcaacaatgagagcttaatatagttcgagaagtacaggtaggcagagctgtgtttgttctgtccctgagcaggtgtaagaggacggtctgtcacacatcaggcaacacaatcaaaggagtagaaatcacagtgtccaaaagagagcaaggaatgatcaaagctgggagaggttggtctgcttaccacctccccctacaaagttaggattattttgctactttaagcattttaagtgtactgcacagtggcattaaataagtcacattgtcgtacaaccaccaccaccatccaactgaaactctgaacccattaagcactaattctcccctcctctctctagcccctggcgaccaccattctactttttgtctctatgaatttgactactctaggtacttcagagaagtgtccttttgtgcccggcttctttcactcagcacaacgtcctcaaggtccatctgtggtgtagcatgtgtcagagtctctccctcctcctaaggctgaataggtcggcttgattcttgtgtcatgaaggactcaggcggcaaatacctagctacccaaaaatcccagcggatctaactcccaacatgtcatttagtctgcctgctaaaggaaaacggtgattcagaaggacctagagaccactgatcctcaaagcctgttcctgtgttggaatgaaataaggggcttgctaaagtttagactcctaggcccctccccagagccactgaatcagaatccctggggctgagcctggggatctgcacttggaagcttcccaggtgattgcaatgcatggtgcagtttgaggatcactgtctagactgaataccagggtggggaaattgtacagataggtttatgttcctgttggttagcaagcaacaaagcaaatcaaacacatttaaagtagtattagttccttttattccaaaaagttaccaatagatgtttaggtggtgcatcacaggtcgaggaaacagaactgaaacatgcttatctgaagacagattttaaaactcacccaagctccctgcttttgcccatgctgggctatggccctggtgaacccttcctctatggtctagactgagcctagaaagccagcccaaaccctagtcattcttcaaaatatctgggccaactttgattaagttagacattacttaacgttaagctccagtttttttcacctgtaagatcgggttgttgagtgattacctgagaaaatgcttttatccataaggcattgagactttgttaactttcagcaaatttgagctgtggttactctggtttcctcaactgctccccatcctgagttcccttgcctgtgctgcctatggcaccacttcacacagggtattaaaatcagagggatgggctggtctctttcattagattatatattctctaaccacaggaactgtgtcttcatcatggtcacacaagatagtggcggacaatgtgggccttggacccagactgcctgggaccttcctggctccatcacttactaattctgcgaccttgggcaaattacttcacctctctgtgcctcgtttcctcatctgtaataacagtgtcttggggctaccctagggctgataatagtatccacaggcctcaggagctgcagagttaatatacgtgaagcatttagaatcaccttggcacctagaaagctgtccaaaatgctatctactggttatttaaaaaatctttgtatccagtgcctggcatacaggggggatgcaagaaatatttgtgggagaagtgacagaaagcaggcagtggctgcctatgacgggagcccggctggtgagtggaacagacaaacagggagcgtctcagggtgatggaaagtttctatatcttgatgatggccatagtcacacgagtatgcaaatatgtcaaattcaccaaactgtacaattagatagaatagatgcatttttcacgcctgtaatcccagcattttgggaggtcaaggcaggtggatcgcctgaggtcaggagttcgagaccagcctggccaacttcgcgaaaccctgtctctactaaaaatacaaaaattagccaggctaatttttggcagatacctgtaatcccagctacttgggaggctgaggcaggagaatcgcttcaacccaagaggcggaggctgcagtgagccgagactgtgccgctgtactccagcctgggtgacagcgagggactgtatctcaaaaaaaaaaaaaaaggtgcatttaatcatatgttatacttcaacaaaattgacttaaaaagcaaaagtaaataggaagaaaagaaagaaaaatcccaaggctgctaaacttgtttaaagatacacatctccacaaactgctgaatggaccaggaagttgaaatctgttcatcaaggggctacatacctaagctggctgtatatggaggtgaacgaagctatagtagaagccttaagctttagaagaaatcggccttaagaaccactcgaagcggctaacctgcatcctgctttctggccaaggtgatgaaaacctctcatggtgacagaacaggagtgagaatgctccaagtttgtgagaactggtttcagctaggcacaatgcaacgtggcctggggcatggaacgatctggacctatgtgtgtttgcatgtactagtgtgtgttgtgggtgcaggactcaacataatcatagaatcatcccacggtgctcagtatattttcaacacttattcatgcaattaatagaaatttcaatcctttaagaccttccagtgaaacttgtattagtctggaacaaaaaagagatgtaatcagtccagttgtttcaaaatatagtttctttctttgccaaaggacccaaaagctacacagcttggggaactaggagaaagaatttgtcctgcggaagatcccagattggcattcctggctccatgttctgggaacaaaaggagggggcaggaaggaaggagccccttctacccaatcaagggcttcccgtcacagcccctgtggaaactgtggtcctccatcctggccagagaaagagccaccagggaatggcataaggggttagaacagttgctccctggctcaggtaaatatagcacgggggtccctgaggaagcaaatttggcagtctatttttaatagaacaagagaaaaataatgcttacatttcttttcagagccaagtttctaattatgagttttaaacaagatgtgtgtctatggccaggtgcggtggctcagacctgtaatcccagcactttgggaggccaaggcaagaggattacttgagctcaggagtttgagaccagcctgggtgagtgaggccctgtctctacttaaataaaaaaaacaaagaaagatgtgtgttaatgaaaggatgcaaggcaatggaaggcaggcagaaatgcagccgagctccccctgccatgtccctcctcccactcctggggtgggcagggccacttgcccgtggtggtgacggaacactgcctaaaactgctcaaacctctcctcttttcgaggccctgcccgcccctcccatagttagtagctccagttccatgtgggcattcctaccactgcccccagcactttctgtgtggctctgtctgtgcaaccccaggctctcctggctgcatgttcacctttgtgtccctccagcacccgtgcagtgagcatccagcacgaggcaggcaccaagagttccttcttgtccccaggttccaacctcactaatctagccctcagacgatccccatcccttcttagaactcaaagattatctccaaaactgtgagtgtccctgattatgtctagaataaatgtttccagaacaaattctccatgactagcctctgctgcaattctcaacctttgctcagtctcttactaagccccaccctctccactgcacaaaccacactgggctctgctgttccgcagcagcatcctgtacttccctgtctccacacccttgctcaggcttttctttctgtctggaatgccctttcctcttctccaactacagccactcatccctctggggaactttcctccaggtggccttcccccacccagtggaacagaaccgcctttcctgtttcctcctgatggggtctgtagcagcctgagagcagggccaagtcttcactgtgtctgtaacccaaaggcccactgcagatgccttacactatcaaatcaggttcccggggatagagtcttatagctttaatgaatttccttcatagcacttatactctgaaatggtatatacatttgctgactataagacagaaattctgagggcagagactccactccttattctattcaccactatacacccaggaattactactgagcacagtaggtgttcaatacatttggtttattcctccaaaaactaaaaatggaactatcatatcatccagcaatcccactttgggtatttgtccaaaagaactgaaatcaggactttgaagagatatctgcacacccatgttcactgcagcattattggcatcatttctttatccattcattcattgatggacgctttatggcaacagccaagatgtagaaataagaaaagcatccatcagtgaatgaacggatagagaaaatgtggtgtacacatccaatggaatactattcagccttaaaaaaaattctgcaatatgcaacaacatggatggcccttgaggaaaaaaacatgctaagtgaaataagcccatcacagaaggacaaacatacataattctacttgtataagatatgtaaaatagtcaaacacacaaaatcagagaggggaaccatgactgccagaggctgtggggagaaggaaatggggctttgctaatcaaccagcataaaatttcagttaggcaagatgaataagttctagagatttgcggaaccacactgtgcctatagccacattgtgcttgtaatggatacttaaaaatgcgtaaagagggtagatttcgttaagtgttcttatcacagtaaaatacagtaaaattggtttaatcaagtgaattcacttgaacaagaaatgtaactgatttttagcaatctggcaagtttagttgcttaaatagtggtatgcgtttctaaaaaagggttgttactaactaggggaagtgtaaatcatctcaaagtaaacatcaactatctgggatcgctcaggtattataaatacacttcgaaaagagtccctttagttaataataacagccacttcagggcaaggagtctctgcattgtttcctggctgagtttacttcgcaactagaaaagtctgcttctgaaaatgtcttctgaaaatgtcattgtggcagagagcaaaatgatagctataaatcaacaactgcagcaaatatttacttagctcttactacattcctgcactgccctgtgagctccatatcactacaatcttgtaatccttgcaacaatcccatgaagtaggtacttttattacccccattttacaggggaggaaaaaagactcagagaggttaagtatccgacccaaggcacacagctgtttctcaggggagcccggattcaaacccagggactcggatcctagagcctgtgctttcacccgctgcgctgcaccatatgtgtaccaggatggtagaatcagaggtgagtgtactttattttctcctttttgatttgtggtttcctaagtgttctacaatgaatatatattatttttatatcaagaaaacaaatatgcatattgtaaaaattattggcccacttgcattattattgaggaggttgttctttttcttctacaatggtgcttctggtgaaggtctggattccagcatttccctgccagaggctatggtgggtgtgccgagcaccaccctgagggggaagcagtatctcagcaactacacccccgaggaagaggcagtccccaatcagcgggagcaatgggacctgctgatgacaaaataagccacagaatgaatggctctgctccactggccttctctcctccctgcccccttttccccagctgaccagatgcagggcagtggcagggaggggctgataccaaacccggtctgggagactgcccggagggaacacaggttcccaagctccttttggagaggctggatgtgagttcacctcgaacctttcagctggtaatggccacctcttggagaatgtaactggttaccagaaaaccccagaggttgtctcccagtacctagcctaaagtgggtgtggccacagaacctaccaaaatttaaataaaagcaagaactaggcgtgtccagggatggcgttgtgctgtttatccgctctctgctcttcccactcctccttcctttgggattttgtccaagactctgtaaattaatttttctgtgcctgtttcctcataaaataaacaagctaacctcacagcctgtccctccttcctctgggggatatgtgacaataacagatgggtgagccacatgtccctgaaggcccctccagggcaagggcgggagagccccacatcacaggttcgtgccacgccacagacatgggaacagaggaaggttccacgccagtactcggcccactgaacgctgctgcttctgggcatgtgaccaagtgaaagggaaaattgggtttcgcatctcactttccatctcagattaaataccagatgaagaagcaggcccatttaaagaaggctgagccctggagaaagacagcaacatggtattatcagtcattttaggctctttgctggagagggaagttggtaaaaaaacctaccaagaaaatcctgtaagtcctggagcctggcttaacaatttcattctgctgggcctcagtttctatacctgtgagtcagatgatcaaaaaggattctttctagatcttaaattttagctatatagggtggttccaaacagtaagcttctttgaaataaaaagccagattcccaggaaaatcgatttagctcagcgtctgtatagtacagacacgaactagttacagtgccagcctaagatgacccttcagatggctacagtagacccttcagatggctacaggaatactgaatgaacaactctaaatgacacaattatcaaacagtaagtttcattttattacatcccttctactggattcatgtgctatatagcatttgggccaatttgaaggtccttgaatgtttctataggtgtaattagttgccccaaagtttaacttattgtcatccaattccaaacaactctatactgaaagaaactatctgaggaagggttgtggaatgtatgacttccaaggatgcttaagaagtcaccccatctaaccttctgatattattatatattaggatgaacagatccaggaatcccgtgtcacgcacatggaaattgtccattcctcatttttcaagtgggctttgtgtataagtcaggctagaaagtctcatacaatatgtctataaatcagacggagttggcgtggcaaacattacttgcactgaattttcttgaggcaaaatgccaacagactccacccaaatgtgatgaggtcaaacatttataagcaaggctttgaccgtgacaatgcatcttgtcattctgtggttcagaagggcaaaggtaatgtttcttcaggctacagttttctaaagagaaatgttaaaccaacgggatgacaactggggtcataaagggctagaaagcaacttctgacctgaagaccccacccctcgccctgccctgttcctcttttcaaacatcttggcattgcacaagtgtcctgcatgcctgtggacaacagctggcactgcagaccagctctagcaattaagttatcagctaaccagctcctcaagccaaactattactcagagacagttatttctgggcttatgtcacagatggaaagaaagacccagtcagtgggaaccatgggaatccacacggggctccttataaaaaaatgactcactgattttgctaaaagtagcccatgtagttaccaacagtatttcaaaacagtcaaatacctccagaaaaggaaatactttaaaaaggtatacatgaaaagatgctcaaccacactaaccatgaggaatgaaaattagaatcataatgagatggtgggcatgtaaacaggcatgccttctacagtggcatttttggcaccagctaacataataaaaagaccgccgctccttttgattccaaaattccacctctaggaatgcatcttagagttacatctgcacattttttggattagtctctatttcatttatttttttacattgataaagaaaaattgtatatatttatcatgtccaacatgttgttttgaaatatgtatacactgaggctgggtgcagtggctcatgcctgcaatcccaccactttgggaggctgaggcaggtgaatcacttgagcctaggagtttgagaccagcctgggcaacaaggtgaaaccccatctctacaaaaaatgcaaaacattagctgggcatggtggtgcatgcctacagtcccagctactcaggaggctgaggtggcaggatcacttgaacccaggaggtcaaggctgcagtgagctgtgatcgtgccactgcacttcagcctgggtgacggagcttcgagatcctgtctcaaaataaaataaaacataaaataaagtaaaattaaattaaaataaaacaaaattaaatatgcattcaatgtgaaatggctaaattgacagtgcaattagcatatgcattacttcacatacttgttttgttgtggtaagaacacttaaaatctactcagcaatttcttttttttttttttgagacggagtctagctctgtcacccaggctggaatgcagtggcgcaatctcagctcactgcaacctccacctcccaggttcaagtgattctcctgcctcagcctcctgagtagctgggattacaggcgcacgccaccacgcctggctaatttttgtatttttagtagagacagggtttcaccatgttggtcaggctggtctccaactcctgacctcgtgatccgcccacctcagcctcccaaagtgctgggattacaggtgtgagccgccgcgcccagccagcaatttctttttttttttaagctcctcccttttcagcaattttcaagatatatttgcacgttatcgtgccaactgtatacacttgcaccgtacatgctaaactgtgtaaatccactgtggcactgtttgtaacggcaaaagattaggaacagcctgaatgtcacccaccaaaaggatggcacctattaattctggtctatctatatgatggactgcgggaggcagctccgaagtacagacatggacaagctccaagatttactataagtgggaaaatcaagacacagggcagtggagcgaatcccgccagggctccacgtgagtgggcgggtgagctgggagaagccccagggtctgcaggcagggtctgctctgggagaggaactgggggatatgggtggtacagacattcttcactatctttttgtagccttttgtcccaagcacatacacacctacccaccgcagggtgcttcagaaaggtgaaacgctgcatacatggtctgatttgtgctttgcatctcgatttggattccaacaggaggcaattttgagaaagagactaagattacaggtgaatggaggtttcttgaggaaactgcatcagggcatgtgtgagaaatatccctagatacaagaaagaggattatggcaaaaagaattggaggagtgccagaagccgggcccctcagccacacccgggaacactgctcccgggtcattctcttcagcaggtttcccacctccagcccttgtctgcactctcgtggctttccatagctctacggtcaggcccaaatacttcacgcaccctcaccgcccctgctttggatctctggaagagcaaggcccttgtctgagtcccaggactcggccatcctctgccctcccctgggaaatgctgagcgcttggccgagagggccctctgagctgggtccgtctattctgggaccaccccagttctataaaatgaatcatgaccgcccctatcaccagttattaatcatgatccatgttaaatggtttacacatgttatcttcaaaacaaccctgggaaggaaaattccctcactttataaaagcggaaagaggctcacagggccccatgctgggattcaagctcaggtcagcctcctccagggcccacaggagtgtgcctgcatctccccacctccctctgtctttctaaggaaaatacagatgctccctgaaagccttgttattttcagcgtttccccaaccacaggcttgtttggatggtcgagatgcctgcctgcctgccgggcacaggtacatgaaacctgaattcaagccacacgtgtatcctggggaggaccttttgctgtttccctctcactctgagcttcatagataacaggaacggctgatatctatggagcacttaggtatgaacacagatcattcagattctcgtaagatcccactgtacgagagaaagtaccttcccctgttttagagcaggggaaaatgaagctcaaagaggtgaagtaactcgcccaggttgcccagctggcaagggaaagagccagggacagggagaaacgtgcccggccagtgtttctcggcatggattgccactgcctctcttccacctagaatcctgcatttataatctttccctcccaccttctaggctgggggttccccactggtgcacagtgattaggagggagagaagctttaccacctctagcaacagggattgaggctgtgtaacaggaatgtccccataaaaccagggaaggttattaaacgtttcaaagtgtacctgaaaacttaaaaaaattccttctttattttcattaggggttcctaaaaatcctagcttccgaagtaggctaggcgggggtgctcctgcaagcagtgagacacagacagaggacccagcatcaggcctcacgccctccctgtcagacgcccatgaggccgacagggtcacttggtgactcctgcgggacagtcacctctgcttccttccaaagccctgccctggaaggaggctggttagtcacagagcctgccccaccccatcgtctctctcactcaagttctcccctccgttctctgagagggcagccttcaccctcgggcatacagagatgcaggacaaagcccaggttggtttcggtaggttctccaagtttgccagccccttctttcacttgttttggggatggcagggtatgtaggagggacaggctcaggctcaggagtggtggctcagccctaacccagattcctcaaaatggggccccctgtatcagaaccctctggaccctgcccagatgcccctgaaccatgtgccaggaagtttttttttttttttttcaaataaataaatggagttttgctctgttacccaggctggagtacagtggcacaattatagctcactgcagcctcaaactactgggctcaaggttctcttgcctcggcctcccaaggagataggactacgagaacacaccaccacacccaactaatttattttattttttgtggagactgggtctctctatgctgcccaggctggtctggaactcctgccctcaagtgatcctctcgactcagcctcaagttctaggactacaagtgtgagcccctctgcctggctgaagcagcattttaacagctccccaggtgataactgtctgtggaccctggggctcaccgtgctagtcttccgagcatcatttgcagccgtgtggactccagagcaggagggggcagcagggaaaggctggcctagaacatatatgccacatgtatgacagagaaggaaaggacagcaattgcacggccgaaggaaagagaaaaaccagcaaccaaacacgcccagagaactgagtggcaggcccagggctgttcttgcccagtacaggaagacccggacattcctaataattctaggtaatcaacagaagattgaaaaagacaatccttcagtggcttcctggtactctcagagaaaaatctatgcacttccccagggcctacagctcacagcaggtggcgggggggcctcctgatctcatcacccaccacttcctggctgctccctagcctctgccttccccgaatctgccaggtctcacctactctctgcctttgccaatgcagctcctcctgctgaagagctcttcccccaactctctgccaggcaaaccctccattctttacgtccagcctaaatgccacctcctcagagagccctccctgactgcccaccccttgctgtgggacatgtctttgtttcaattgcatttgttttgtgttttggctcctctatctcccctagtatatgcttcatgaaggcagccatgaggtctcactgttgctgtgaaacctaaggcacctggcacctgacacatagtaggtgcttaagaaattgaccagggggcacagcagagtggggtgcacagcagacattcaacataagaaaacctctttcccctttccactatcctaggagtgagaatgcagggtagtgtgtactcttttccaagcaaaattatcatcaaaaattgctaaaggaaaaaaataggagatttgatgttgctgggggaaagcatcaattacattttctcatggggtttgctgccttctccgtgtgtgtgactggcagctgtattttgccctggtttgcatccacgcctcttgtggttaacagcacgcactctggaaccagactgcctggtttcaatcccactcaaccacttattggctattttggtcatcagccaccttaaaatgtagtggcttaaacaataacttctattttctctggaggttctgtgggttgactgggctcagttgggttctcgcttggggtctgtcagaaggtgatagtcagacagtggttggggctggagttacctgacagctcaactgagctggttctgtgatggcccctttactcacatctcagctggaccagccaaggaggctgcctgggcctcttggcctctccttgtgactagcttgggcttccctcacagaatggccgtctcagtcacagtatgacaactactaagagtagttggactttttagatggcattcggctttccacagaatgaacacttgtagagatttaggtggaacctgcagggcttcttatgacctagccttaggaaatcatgaagtatcacttttgcagaattctactgatcaaaagtgagtcagaaggtcaatccagactcatgaagagaagactcccaaggcacgaatgctgggaggcacaggtcttggcgtggtggtgggaggaggcagtatctttgaagacaagctaccatacttgctacatgattgtcagcaaatttcttaagctctctgtgcctcagtcttctcttctataaaatgggataattgctcctacctcacagagcttttgtgaggagcaaatgagttaataatatgtggaaagcacttaacaatgcactatgagagtattagctattattattattactcaaaagagtaaggagcaaatgtttttctctgattaatctctgtatcccaatgtctgagatatcccgtgaaatgttttatatcataaacataaatatgaaatgctctatatgcaaagtaagtgaagtgtccttctccccatcaaataaaattttttgtttttcatctaaaagtcaaggtttcaagtttagataaaaacagtcatttctcacaatcaataatgcatttgatgtattaacaaaaactcaaactagctgccggggctggcgaacgctgttgtgagtcacagtggcgatatgctcacatcagggccggaagcagtaacacttgtggtgtggaatttcccgtggcaccagcggaaaaggagtctggatgcgtttgtcaaaacttccccgaaacaaaaagaaatcaggatttcctgctagaggcccaagtggctagtgatgtccaggacctcacaacccaacctcagactggccttagccctggctggaaaacaggatctgccaacaaatcatcagggctgggccccagcctccagggatggacacttttctgtcactgccaaatccagacaaagctcagagtcaggtcactgaatgcaaactctaaataaaaaaatggcttcatgatccacgcctgtggctgcatgttctattctacagaattctccaccacgtcctcccatacctcctacccctcagtattccatgtggccttcaggacaaattcgagtctcctgccacatgcgcccacctgccatggacccatgttccagccacatgcacagcttccgttcctccaagggccctgagctcacatatctctctctgttctttcatacactctttctgttgtctagaagagatatcaacaggaagggcagccacagttctctctccctcgactcggtgctaggcagaggctgtggtaagagtgtcatgtcttcgtctcagtttgtctgcacgctggcctacagcgccctgccttggctggctagagagctcacccatctctccagccaggctctgatcaacagcctttcagaaggatagacacatagagcaatggaagggaactgagggttcttggtcttttaggaaaaaagactcatttcttttttgcatatgtgtgtgttttcctctcaaatccttcttgttaccaaagcctgagaggggaagtcattcttatctggacatctctaagtgttctctctcctttcccgagcaagcttcaaaatccggtcttttgtcttcaaagttcaaaagtggatgcatttgtacttccctgattgtggtctgctggtgcctttttcatttttttctgcacccctcttagtcacagcttggatgtccaggccccatttcctagctctgtcgattcttttgagatatgggttgagtaaaccttatccgaaaaggttgggactggaagtgttttggatttcagattttctgattggggaatatctgcacatacatatataatgagagatcttgggaaagggacccaagcctaaacactaaattcatttatgtttcatagacaccatacacagatggcctaaaggtaattttacagaacatttaaaataattttgtgcatgaaacaaagtttggatcgtgccccgtcacatgaggtcaggtgtagaattttccacttgtggcatcacgtcaaaaagttttggattttggaggattttggattttgaattttcagtttcaagatgttcaacctgtattgtgtttgagcaccttagctgtgttggcaggcccttgaaacagcctgttcctgtttatatcactacccaggcgcctttttgattcttgagggctttccttaacatctccttaacattgcctaggaggacttaaagatgtttgtatatagacgttaaaatggtaatcagtgattctgaagtttctgttattgcccgtcatgttacctgaagtgcagttagatcctcccggcttcatgtactattactgtccactgcttttaccagcagggcattttctgtccttttatttttcattgtcttcccagttctattcattggtttataatgaataggctgggattaagaggcgagagcttaaacatcaggaaaagacactctcgaattttcatttgacagctgttgttcctgagagaataagtcgatctgttagaaaatttagatagagctttttccttctagagttatttaaatttttaaaagggagaagctgtactatttttattaccaaaatcaagtctattgaaggctacgcaaaacctcatattctcaagaaaccataggaataatctgtggttaaaacagcaccttgaaaatgccaaatgctaaatagattgataagaataccagttgctacattataatttttcaaaggatgttatgattggagtcagaatccggaggtttgtactaagtagctgggaacacacttgtgttcatgctaactctagaaatatatcctagattatgtttaggttcagcatggactcaatagtattctaggaaacagtatttcagcggccagcatgataagaggtcgagtgggaaggaaaatgctatgcgtgtggataaaggtgctctttcttctcatcgcagagtcaaacacctggctgctatcaccaaggacaaaggatgttctgaagagtgaaccaactcagatttacccacacacttcaagaaagcaatttagaaaaccgcaggaatccaaacattctttcattggctactaaaatacaagaaaagaaatcaagaaaagtttgtaggacttttaggaagctattacttgatcagaatattattattataaatatatcagaacacttttatccttgcttgatgggaattcaacacttcacgtcagccaggaaagctacaggttagtaactaaactaacctagtctgttgtccctaaagattttctgccaatggccaggcatggtggctcacacctgtaatcccagcactttgggaggccgaggcgggtggatcacacctgaggtcaggagtttgagaccagtttggccaatatggttaccatactgattatcattttaacatttatatacaaacatctttaagtcttcctagacaatgttaaggaaatgttaaggaaagccctcaagaatcaatatggtgaaaccccgtcacttctaaaaatacaaaaattagccaggcatggtggcaggcacctgtagtcccagctactcaggaggctgaggcaggagaatcacttgatcctgcgaggcagaggctgcagtgagcactccattgcactccagctttggtgacacagcaagactccgtctcaaaaaaaaaaaaaaaaaaaaagattttctgctaaccataattgaactaaggaaaacttgaggggtaaggagtttccatacggagtagtatactaaaaattgctccaaaatcaattgccctcatgggtttcatttatacggctcctaaacaggagatttagatgacgtttactcccctggaatgctatgtatttttttttttaaataaatagggatgaggtctcactatgttggccaagctggtctctaactcctgaactcaagggatcctcgtgcctcggcctcccaaagggctgggattataggcgtgagccaccgcgcccagccactcagcttttgagggttaatcatcaaccgcacaaaggggaaaggaggagcagtggagggcagtacacaagcggccacctttcctccttcccaggcacaatgcccataagggaggcaaagacccgccaataaagtcagtgggggatgctttaaacatcttgtggggtcacagtttgtacccagtctattatcccatgttgacattaattcttggcaaaggtggggctgtggtcttatgaagctggtcttacgaagctgggtgtaggtgtgagtatacgtgagaacgtggcactgtttgcaatcgtttgagctgaagctgctttacaacagtatgcattctttggggttagtgtgttgaaaatgtcagctgagtgacttccaccaccagctgcgcccctaacaccgtgtggcaccgggcttgggaaccacagctgtggcccgtcgtgctgtcatcgcttgtggctctgggtccttccccacctgttgctgtgtccgtcggtgtggcagggaccgccgactggctggaacatatatgctatttctgtgcataggatgtgagtaagtacatgccatagtaagtcagaccaggatatgagtcagatcatattataaagtgatacaaagaactgatcttcaaagcattctggaagcattaatccacgtgtcaacactattgtaagggagctacagtttgaaagacacgattactaagcaaaggagagacgctgcaagactcaggtgaacagaactggctaaaggcctaccaatgaaaacaaatgcatatggtgggagccaaaatccggaggccttaaaatttagaggtaaaaagaaagagttagcaggaccacatatttctccagcatattcagtcagaaatggagaagcagtgaaacacgggcagctcagaatagctgtggaacatgggcctgctttattatccatactatctgcagagcaacctttctggggctaaattaatggtcctcaactgactcttaaaaaaaaaaattgattggcactgaggtgtaaagacacacataaaaagacgaccatccacagcactatttgtaagcataaaaactgattaaccatcatgatgtccacaaatcagcaaaatgaactatattatgtcactttcatggaacccaagtagctattaaaaggaatgaaataatctgaatatactggcatggaatgatgtccaaggtagactgttatgaagaaaaatcaaggtgtagaaaatgtgcatggtaatcccatttctattagaaatgtgtttgcatatgcgcaggaaaaagtctctaagaagtgagagaaaaccattaataattgttaaatgtgacagtgagttttttttaaattcttattcattgactgaatcctttgccataaacatctatacttttataatagaaaataaagccaacaagatatttatgaatagcattaacctgttttttggtgtttttttttttgtttttttttcataattgcaaggttcttggaggcccgggaaaggtgaccttaatggcattccatagctggcaagtccctgactgaaacagtgaaggcacagcaggcaccctgggaggcctcggctcagcatagccccgagctctctgcgggaccacggagcagcagagatggcattcccaaaatgccaagagaaaggagggcttattggcctcggaatccctttcttgacccctgtcacgggaccctcactggcctatgtaactgcacttctgctttgtgagctgtggggtgttcactgccttgtcataacctgcgaccgtgaccccacacaggcttctgctcaaccctggcatgcccagacttctcagcacggtgctaccgacttgctgttcaaggggttgtgaagagttctcagccagaagtgatggcagcgatgcatctgctccatctcctccctcccagcaacccgcctttgtttcaagggccagggcaaggaaaagacttgagctgcctctggacctgtgatggcaggaacccatcctgaccctcccgatcaggcatttcctctccgtaagtcaactctgtcctctggtctgcccctgatgcccccttcctccaggacggagggagatagcaggcccaccggttttttgtttttttttttttttttgagacggagtttcgctcttttgcccacaggctagagtgccatggcatgatctcagctctccgcaacctccgcctcccaggttcagctctcgtgcctcagccttccgagtagctgggactataggtgcccaccaccatgcccagctaatttttgtatttttagtagagatggggtttcaccatgttggccaggctcttctcgaactcctgacctcagctgatccacctgcctcggcctcctaaagtgctgggattacaggcgtgagccactctacccagcagacccatctgttttgactacaaagcacaggcctagaagcagctattgcctcagccttgtcttgtgaaggctggagaaacttatgcttcggcacaagcattttctatccttcacagatcccctctgaatgcttcataatctctccctaccccacagcttcccttaggtaattcctactccttcagatcctagttccaatgctgcttcctccaggagcctctcccaacacccccgaggccaagccaggtcccctcacacctcgatacctcccattgtttaccccactcctcatcttcatttactcatgtgtaacttgacaaatgtctttctcacagaatataagcctctggagggggcagagtctttgatgctatgaactcctggttgacacttggggccccttcagctgcccaacagctgtcctggaggacggatagaataatatagggacagaaatcctctgctcacagcagagagggcctcagccagcacttggtggggaggggcagggacaggcactgacctcggctgatgcgctgcttctccccagaaaggatgccggggctgtcgatgacgctgatgctcttcaggacctgattggggagctgtgagcacatgaatctggaagagacggatcaaaggaggggtcagaaactgggcatcacagagtgctccaaccatggggcttcttggcctctctgggcttactgacatctgtaaagtgggggcctgaaggagactgacagaaactgaggatgcctaatgaagttgtttgtgaagtaggagcttggaggagattgatagcacctccatccagccacagagaacagatgctggcccatgggacaggtatgagaggtgcacaagcacctgctgccatctgccacctgatgcctttctgttcattttgattttagctaacatttattgaacatgcaggtatcttacaaatatcctctcatttgatcctcatattgacctcatgaggtgaaggaattatgcttaacataagagaggttaagtaatgctcagggtcactcagagcggtgccttaaaccaaggtcagcctgcctccaaagccatgggcctcacctctcctggctccatgctggcccctgcccaagcatcctgggcctctccccctgggaatcccatgccttcttcaggatgcactggcccactgggctggagagccccaagctccctgcctatttcctagcatgaaagctgaagggactggggcctgtttccccatctgatgccccaggaacttagcatccagcccagtgtcccctatggctttagggccagggaggggcaggcacctgtgacacccaacatcctccaggtgcttaggagtctaggggagctggagagtaggtgaggggaccaggttggggaaggccctggctgagcatctttaggcccctcttgttcctcatttgcctgataccatctcctcctcctgatcctggtccctttccctgtagtcactgcccttgtatccactccacggaagcagagtgcggaggaaaaatctagcctgtgggtcagcagacctgggttcaagttctgcccagcgtttcctgataatctgctatgggactctgggtaagggcctccctgctctgggtcttgggttcctcacatgaaaatggtggcttcccgacagggtctggcgatgtccttttagctttcagactgagtaactccaaaagtgatggcaggaagtgctttgttacttccaccctgggcaccagggtctgggatggacctttgtgaggcactgtgcatgtttaaggcagaaagtgtagaatgcctctccttttcctttactatggatggctgacatctgtgtctgtgtgggcagaaagctaaaagctcaattcttccgtacgatggaagtggtggggattactcacaaagtaaaaatgctgggaatgcaggacagggaggcctggccagcctccacagtgcacatgtggacaccacagccctgggtatgagcggccgttactgacatttcaaaatcactttctctgaaggggcttgggatacgatttttcacacagtctttcctacattttcaaatcggcccaggaagatatagaaaaagacattaggatccttttgcaggtggaaaagttgaagcacaaagcagttatgacattctgaggccatgctgctaatgcacggctggttgcagactgcaacctactgtttctgatgtcagtggggtggaatttaacccacaaagttaaaaacctcataacattaaaagtaaagggtcaagttagtggaagagaagcccccaatttccacctgtctgcagacacttgtgcacagtcccctcctgtaccccaacctttaaataaaccctactacccaacacggggagaggtttgtgggaataaagcacatgaggctcaccaagcattctttgtaagttcacagaaaaaaccccaccatgccattattcaattctctagaattggggtgggaacagggctctgggcacatccgtggtgaacctcgtttcttgtcaggaatgattgtctctcagtgccgtcccattctttccatcagatggcccgagacatctggcggagctgaacatatcacacctacgtgaaacaattttctgcaaaccattcccgtggacaggctgatcttttccccaaaccacaagctcacactcaatatccatttttccaaaacagccaccccctagattctcaggtgaggctaacagagggattcaaaatttgcacactgttcactccctgtgtataaagtgacagcctttccacagctcccaggcctcctgacatgacagcagaggccaggcacgggagccacagagcaagccaccgtgagatgtgctgacgtcaccacatggcatacaagcgggcaaagcgaggagcccaggatggctgaaaaagagaggatgaggagcagcaggtggaggcggagggagagctttggctggggcacctcaagagtgggcagctggggttttgggtgcacagctggactctgctccctgaaagacagtgtccaggggtgaggggcaggcaagagaacagaaaggagcattgagaccctgtggtgccacgctcatgctgcgaggtgacaactgcatatgaatgcattcgtacgaagttatgctgggatcagaaaaaatcctaatggtgttctagcaatcatgcctcatgcttcttctctgagaaagggaggcgcacggcaaacgtacttgctgtgtgtataacagcagtgcagtggtagtcgtagcccagtagtgaagaacctgggctctgcagtcagcactgccaagttcatgtcccgaccccatcaactcacagccgtgggactgggcaaggtatgtcgtgtgactcctctgcgcccagtctcctcctttataagcagaggttcacagccctacctgtaaggttgtggtgagcctggagttaatgtgcacggaaagtgctttgaacggtgcctgacacccagtaagggggccctggccggcccagcttattgaaatgcttccaagcacagatttgctgtcccaagatggatttcctactccttcctggggagattaacacaaggaggatctgtgccttgccctctacatttcacgtaaaatatgcagacacatgctggttcaacccaggagcctcacatggccctcacccgaggatgacctgataaatgttgtcttctgaagtaagagaagaagacggagcaactgaagatcctaggctgccccctcaactccatatcctctccacgtctaaggaagggccaggggtagcagagatgggggataaagtaatggtccaggctatgaggtctcaggcaagctgctaggagtcctgccacacagtaaaaggagagagcaaagccaggcaccatgactctccctgtaatcccagcactttggaggctgagtggggacgatctcttgaacccaggagttcaagaccagcctgggcaccataatgagacttcgtctctacaaaaaataaaattagccgggcatggtggcatgcgcttgtagtcccagctactcaggagcctgaggtgggaggatggcttgagcccaggaggtcggagctgcagtgagctttgatggtgccagtgcactacagcctgtgcaacagagtgagaccctgtctcagataaatacatacatacatacatatctacagaaggagggggcaaggagattacttaaaatttcccccaaacactaaaattccaattaaatgatcagcattttaaaaactagacttttagaagaaccagacagtaccttaatactgattttgatttctcaacaaaacagtaatatctgtagcagttataataataataaaatagcacaaacatttcctcacctcttactgggtgtcaggcacagtttgaagtactttccatgcacattaactccagccttactgcagccttacaggtagggctgtgagcctctgcatttagaggaggagactgggcacagagcagacacatgccataacatgctgagaagtgatggagctgggacatgaacttggcagtgctgactgcagagcccaggttcttcactcctgggctactatcaccatggcacacactggaaccactgctgtgtggcatatcatgtgcagggcaacatcctaaaacaaaggggtgacgtgccacagccctggaacttgcccctaagaggcttccttgtgtggtttgctctctacctagtggtgtggagtgtctgtcagggtggggaacaggaggtaggagatttaggctccagacgtctcccttactcattctgagaccttgaccttgcacaggtctctaaacctctctgagcaattctaccaggcctgcggacttccaggtttgccattaggttcaaataaacctaagcttacagcggagagagtatagaattgtttcaaagtacttcttttcaccccagcccactttattgatgagggtaaaaccagagagataatacaacttcctaaatttgcacagtaaatagaacacaacccacaaaaaagactttgacaactgaactgtaataattcttattatatggtcctaccacaaatggctaatcttatcttccagtgcctaggaagaactaggaactgaatttcacatccagattacagcaaagcccctggttgccctattagattgaaactaattaccacttttaaaggttaaagattatttaagactgccaatttcatatggttcaacctaaatatgtacttttataaatcccctcctgactgccacaggggaaagcccagtgcaatggcccagccaggaaggtctgcctgaccccagggagaaaggcatttctggaatgtcaggaccagaaatgtacaggcagctgctagtcaagaacaatggtttaggccaggcgcggtggctcacgcctgtaatcccagcactttgggaggccaaggcaggtggatcacgaggtcaggagttcaaatcagcctggccaacacagtgaaaccctgtctgtactaaaaatacaaaaattagccgggtgtggtggtgagcacctgtaatcacagctactcgggaggctgaggcagagaattgcttgaacccgggaggcagagtttgcagtgagccaagattgcgccactgcactccagcataggtgatggagcaagactccgcctccaaaaaaaaaaccacgatggtttagtgaccagggaactaccacccagggaaccaccacaaatcttttttattattgttatttttttagggacaaggtctctcgctatgttgcccaggttggtctcaaactcctgagctcaagtgatcggcctgcctcggcctcccaaagtgctgggattataggtgtgagccaccgtggctggccaacaaatcttgaggttaaagaataatggggaaagcttcagcaagtttattatagataaatgaaccacaatacacatgcacaagacaacccagttattccctcagattaaaaaaaaattattttgctggtgaatcaagagtcattcttggcaaaagcctgttttccttaatttctgcagctaaattggctgggggaagccgcacgtgcttggactgatgctgtgaactttagtaagtcagtttttaaaaattcccagtggtacacagtgactatcaaatattcaaaacttggctaggcacagtgtctcatgcctgtaatcccagcactctgggaggccaaggcgggtagactgcttgggcccaggagttcaagaccagcctggccaatatggcaaaaccctgtctttacaaaaaatacaaaaattagctgggcatggtgacacacgcctgtcgtcccagcaatcgggaagctgaggtgggaggattgctggagcagaagttgaggctgcagtgagctgtgatcgtgcctccgcgctccagcctgggcaacagagtgagactatatatatatatatatatatatatatatatatatacacacatacacacacacatacatatacataaatttggccaggcatggtggctcatgcctgtaatcccagcactttgggaggccgaggcaggtggatcacctgaggtcaggaattcaagaccagcctcgccaacatggtgaaacctcatctctactaaaaatacaaaaagtagctgggcatggaggtgggcacctgtaatcccagctactcgggaggctgagagaggagaatcacttcaacccgggaggcagaggttgcagtgagccgagattgcgcagctgcactccagcctgggtgacagagcaagactccatctcaaaaaaataataataataaaataaaatcaaaactcaaaagctaaactgagtgaagcctcgcttaattacaaatacagaagtaacaaatggagtagaaggtcaataatacacctgcgtattttatgatgggggaatcaccattcaagcataacacagtggttgtttatcatcaccatcatcaggcccagctaaaatgactgagccctggaagggctgttcacattccttcagctcaaagggaagtttcaaaatttcaattcccagggccagtgattcaagttattttttagaaagaaacagaggcaatgaggaagtacatgagattaagaatttcttctgtggaagataacaatttaaaataatactagatcctagacaaaaaatgtctacagctatctgaatttgaaaatatacacattaccattttttagaaaaggagactgaggaataacataacatcttattcaaaagcagactgcaaggggaaatgtcagaccccaatgcctggcacttccctggcgtctcagaggatccaatgctctgggtgcccttggctgtctcctcctctgtgaggggcaactgcctcctgatagcaacctctggaatgtcaacaagcacctccccagagctgctcccagatgggccactgaggaattcgtcgtgagcacagcagtctgctagagtttcagaatgtctcactaaagccatttccatagacctctgtgtgttctaaactccttttattgttcaagtatggaatttctctaatataaacctttttaggaatttatcttcatttctcagaaatgcaccatagaccccttgtcgctccttagaagccagcctgggaggctgtgactcgggctttgctggtttgcttaatggtggagggtgttgtccccctccaggtatcacctggtacttaactcttttaaagatgcccctgggggcagatgcccaagccagcactccttaaggagaaggccaggtaataacgatctgtcacagggagattctggtgtggctgcttgggagagaaagttctccgcagaaaacaagcaattttctttactaggtgttacattttgacctagttcccagagaagtatgctatgtgaaaagaggtttgcctctagtactaaccctgtgctgttcccagacggaagctataattatgtacacatatttgaacgccctaactaattgactctttcttaaataactgctgtgtgatgcagtggcactgtcctgtggatactacttaatgaggctgtttactcttaagtagctatgagtttacatgaggcatgtcccttacacgtgagcctgacacacacttggctagaaggacagaaactcctcttggccgatgctgagcagaggcatagggtgtgggacaggggagaaggggaacactggattccaatcccctctctgcctcttcctgatggcctctccctgagcaagtcatgtctttgctttcggccttctcatttgtagattggcaacagtattgtctgtgttatcaacgccaaaagaataatgtacatgaaattacgtaagtgatgacttgggacataatcaccgtcatcttcatcatcattactggagggctacattaggaacagccttactaaccctaaccctaaccctaaccctaaccctaagagttaaatagggggcactgggcagtgattcccagtccaaacatcatactattggtcagctggcctgggttccagtcccagcactgatctcactggtggagtgacccccagaaattaaagtaacctctttatgccttgattcctccccctccattgaggataacagtagcatcatgtcacaggggttctgtgaggatttaaagctaatacacaagtctagaacagaatctgacacataaatgccatataattatttgctattatttttctatatgttattctgaattcaactgacacttgcttttattataaggcatggattattttcagcaagttttaaattctgagacaagagctttgccattcaaaatcgttcctaaaaatttcttttctgtactcatctgtcatgtgcttgggatttgagaagaaaaaaacattttttttttttgttaggaaagtaaatcatttgccaaaataaagcaagccaataaccactcttcctggtttctcccttgtgaattcagacttcacaaagtgggaatttgaaaaaactggcagcttatttcgttaagcctttgttgggcaaaaagagccccagacaaagggcagtggcaatgaaaccagaggaccccagggaagccttccacagagacagatcctgtgccttgaactttctggggcctcctgttctggtctacttcccctccaccctgggccactctgtcctgagagatctggagagttgaccctctggggttctcccgcccagggcttaaccccctctcccacaatgagacactctggtgccaaccaagtcagctctggagttgaagagtaaactcctcctagaaaagtcagccctgcaggttggaaaaaaatcacctggacagtgttcctatcaccatcagtaataagatggaactcctctgggactccttccacatcacctgcaggtttctgttcatcccactgccaagttccctggttgctttctttgatttgcaataggatcatcaaaaagcccctaatggagaattcagctccccggagagttccatcttccacagaaggcacctgcggaggggcctgggtggccctcagccgagccagtgcacagcatccagcacatcattcattccccaggccacatgaatggtgcccctggagctgcgcgatgaggcgcttcggcctttgggaggacagcagccggctgggaggatccgttcctatttttaaaaacttctagaaaggagatgtggactgtcagctctaatgctacttcctctccctaaagaggctcggatgaccctccctagctctgtgcctcctacaacccactcctccaaatcagccacacgaaagctagacccaggaaagagggaaatagaggggtgggagagggatgataggaaacaagaaaaaagcattacacaaacgcaaggggtagcaaataggaggtgcaggagggaggaaggaaggcagatccagtgggaaagggcagagttgtagccaggggtaccagctggcctgtcttccccaggccagcagccctcagttccactgggaactctaatgaaaggttatgggaggagtacaaataaaacacatctccaagtgaggcagaacctcagtgaccccacaactttacatctataaaatagtgaccacgtaggctgggtgtggtggctcacatctgtaatcccagcactctgggaaggcgaggcgggtggatcacctgaggtcaggagtttgagaccagcttggccaacatggtgaaaccctgtctgtactaaaaatacgaaaattagctgggtgtggtggtgggtgcctgtaatcccagctacttgggaggctgaggcaggagaattgcttgaacctgggaggcggaggttgcagtgagcggagatcatgccactgcactccagcctgggagacagaatgagactctatcttcccccccgcaaaaaaaaaaaaaaaaaaaaaaacgaccacgtaagaaaatcagcttttcatgtttttcactctgtttccctggccctgctctgatgaataaggaaacagctcaaagctgggagtgagaagcaaaagggacagccagggaggtgaggggtcctgttctggagtcagtgggtaaaatccgagtgtccggtgaaggttaggggtcctctgggctaagctctctgactgcagaagcccagcgcaccatgcctgagaggtgtctgtctaaccagtgcttaacattgccagtgacgaggagctcactgcctcatgaggcagcctaatccatttctgtgcagctcaaattattagaaatttgttccttatactgtaagcatttttattttttaacttttaaaattttttgcagagacagggtcttacttcgttgtccaagctggtctcaaactcctggcttcgaacaatccttttgcctcagcctcccaaagtgctggattacaagcacgagccacacacctggccctgtgcagccttataatgtccagttctgggccttagctctgccctctcaagttacccagaataggcataaatgattatttcctatgatagtctttcaaatatcttaatatgataaacatattttgtatgacttctagagcagagattctttgttcttctgtttttgaacctttatatgtaactggcagtaattcaaagaaaaggtttaaacagcctgaccgaagatggcagcttgctggtccttaccgattcaggaaagcgtttccaaagcgactgagctttctaaacggctttttggggtccacgactaaagcattccctggggtgctgccctcagtctctccatacatcacggcgatgaaggagtctgtggtgggctccggaccaatcctcatgcctgggaaatcctgctccagtaggtatctgggagagggaagaagaagagaaagcttagcatcttatcacaaagtaagaggccagaaagctgcctgggattaccaatttttttacataatcatttaaaaacgtagaaacataacccccaagaaaagcacgcaatcctcctctgcatttctgttgatgcaacagacgctaccccaagggaagtgtaccgtgctggctcctgggcatcctggaagctctgctcaggctcagctcccttaggggagcctccctgacctgcatgtggggacacctcttttgtggtccctgggcaccctgtgcctgctgccagcgtggtgctcagcatgtgtactacaattacttgtttatgggccctgcaaggtgtctgagctgatgagggcagactcatgtcccaaccatgccaggaggatgatcttcgtcttataagccttgaaggggctcaagggaaaaaacctgcacagccttctgcagctccccattcctgcaactaacaatctatttggtcctaaactacttctttgtttctaaaaagttttgactgattctaatgtaagcccacaatctgtgactatttccagggaaagagagaaagtgctgaattctatcaaatgccaaatacaatttttccatctttaaaagaatgagaaattaagccaccatttagacctatgttttctatgtaaataaaactgaaaaaaaatttttttttttgagactgggtcttgctctgttgcccaggctggctggagtgcagtggtgcaatctcggctcactgctgcctcgacctcctgggctccaacaatcctcctgcctcagcctcccaagtagctgggactacagacacatgccaccatgcctagctaattttttgtagaaacagggtttcaccatgttgcccaggctggtcttgaatgcctgggctcaagctatcccctcaccttggcctcccaaagtactgggattacaggcatgagccaccgcaactggcctaaaactgaaattgtttagcaaccttaacgggctatattctaaacctttaattgatgtcattgctagttttcacttcatccaaagtttctacgtttctgtgaagttgtggcaccccagaatagatacaccattaaaatatgtctcctaaatttacagtaaatctgatgatatcttttatctctaaatttagagaaaaaaatctgctaatagcacacggcatttactgagtgcttgctatattcctgatatggcgctgagccttctatattgtttcacctcatgctctgaggtggatgatgacattaccctcgttttatttacaggtgggaaaactggggcatcagagaggccaagcggcttgcccaaggtcacacagcggatgttcgagtggaaatggaatgcaagcattcagactccagaacttgcactgtcttcagaaatggcctcaagttagtggtttgctcaggggtgaagagcaaagcaaagttcagggcctcatcccagggtgtgtcacttggcatgagggacgaggacccccatttcctctcagctgaggggaagagctctccacaatgtccccctgcacggtcctctggctaccctgacaacaagggccagctctccctactctccctggagtaaagctgggctcaggaggtgctaccgtttcaaaatgtgttcagctttaatttttaaaatatcttcaagagtttctccatcaaaacctctgtatccctaatagcctagaaatgttcgtgttgatcaattcttacacattccacacaaatctgagaaatgctggtaaaagttactgtgagggatgcccactctgtgaaactccagcctctatggagtggatgcagagcgtgtggactccatatacccatgggaatgtggaatttaggttttacagcccctctgggatctcaagggtgaagacattcagcagcgaggctggaattcaaagccagatcacactcttgcctccactcacgtccagtttgatttttacgccctgtggcctggatggggctatgtctggaggctggtatgactgagggaggagagactgctggggagggaggggcttgggagaacagcagccagtgtcgcccagctccccgcagcacacacagttcgcaattcacgaaaatgtgaggtgcgggagtgggtttgaagcttgacaggcactttgctccagaatcagtgctaatagcaacggtgggctggccaagacggcctacaaaaggtcacacacactgattaaagggatgaaccagacgagaactgcagcgtgtgctttttggggaagagctcggtgtggagctccaccttgggtggctcgcggcaacacggccccttctcggcaccttcaccaagcctggccaggaggaggcccttcagattccgggccagggaggtgagcatacggatatcgtagttaagcagtgagtcccccagctggacaatcactcacacagcacaggtgttgaagtcagacatcactgtcgaggagtgcctgaattactttctgatgtttcattcctgtacaagtacagcaaatcccactacttttgaaataacaggggtttcaaggaaaaatataaatgaaaaaattgtttaaagaagagcagatgtttcctacattcaagtttatattgcaatcgaagccagagttttctaagtagcgaccctactggacagacctttaacaataaatcatttttaaagtgtgcttcaagtgtgaaataatttgaagtcaaaggtgtccccctttgactgtgaccttggtaaatcaatctctggatctcagacacagaggaagaactagaattaggaagaattactgtattataaagcttgcttgcattatcaatttgtttggtgatactttcacagataatacaaagttaacattcagtgttcaatttcaccatcaaagaaataccagtaaagacagagcacattaacaaatttttgaaaactcggaatcatcaatgctggcaagggtcctgtgagataaacacccttatatatgttggtgggggaataagttggtctaacttcactaaaaagcaatttgacaccatgtgttagaagcctttaaaatgggggtcttgctgggagcggtggctcgtgcctgtaattccagcattttgggaggccgcagtgggaggatcgcttggcctaggagttcgagactagcctgggcaacatggagaaaccccgtctctacaaaacatacaaaaattagccaggtgtggtggcgtgcatctgtagtcccagctacttaagaggctggggtgggatggtcgcttgagcccagggaggttgaagctgcagtgagctgtgaccatgtcactgcactccagcctaggtgacagagtgagaccctgtctctaaataaataaagaaaaaataaactcaaatggggattttgcggagttgacctctaacagctcgtgctggtgttatttgagggcctgtttcctctcctctcttgggctgtcatttcctgcagggcatggtctatatactcagtactttagaaacctggagtctggtaggaatgatttgagtcagcctcttatctttacaagcgacaagactgagggttagtgcaggaacatggcttgttgctggtcaaactcacagggtggccatgcaggatccagaacctgcagcccctttctcctggccccagacttctgctcttacaccaggcacagcaccatcaccctggggtcctacactgcccccagctccctggtgctctaagcaggacctggcagatccctgactttacatatgacactctaagctgattgccctgaagaagatttttcactgggggactgcagaaactcagattcatctgttacactgctgggtaaacaggtacatgtcagtgcagtgagggaactcggaacaaccaagacaccaagtatctgacatggaaaaagggagaatgaagtgatggatccacacacagcaagctggaagggaagagtctgagctgatgctgaggtgcaatgtgcataaatgggtcaatcacacagccacacgggatagacagcctgatcaactgtgttagacatttctcacggtgggagtgcctcagaggctttcccaaagctacgagtttcagggactctagtattatctgcaataacaacaattcaaaggaacaagaggacacaggaagaccaccgtgattcagagctgattagcccctccacaggcatcctgtgctttggagacttgatttttgtccttggctccactttgctccccctttcctgtgttctcggagaggcctgccaattccagcaatgattgctccaaggttctcgagccaagccagccacataaaaaggtatggacatttggattccaagcagctgggcggaagggatggtgggatggatgggagacctgacatccccttgtcctggtccgatgaggtccccagttcagactcatccaagtggctctggggtaccccggttgccagcattcagcccaagctcacagagctactttgatgcaagagtatatatggatggtgtcttctttttttcattgcttaggctagaattttttttttcacttcatagaagtgaatgtcatttatgacaaggggaagaaaaaaaactctcaagatattgaaaacagagatactctcaatatgtccaagcaccatcttctcaacgatgagcttaagaatgaataaaaaccaaacaaatctaagtggcacattattcaaacaaatgctggagtagtgggcaaagcattacactttaaataaatatacctaacgcttgaggactcgttatgtgctaaagtctttacatgaatagtctcatttcatcctaactaccttatgggcaggtactatttctatccctattttacagatgaggaaactaaggctcaaatgggttaagcggtttattaagatgaaggatttcttactagtcttatgaggacaccacccaccctaaatcagagcctgagaggccgacgggttccactgggaatgtttacaggaacgtgtcctgtgaatcataacaaatacacaaatgtaagattttaaaaataatacggcacatatattttgagtgttgtatgagcattatttttaaattatcaagccaaatctaaagaaatggtttgtgtgggctgggcgtggtggctcacgcctgtaatcccagcactttgggaggccgaggtgggcggatcacgaggtcaggagatcgagaccatcctggctaacacggtgaaaccccgtctctactaaaaatacaaaaataaaattagccaggcatggtggcgggcgcctgtagtcccagctactcgggaggctgaggcaggagaatggcgtgaacccgggaggctgagcttgcagtgagccgagatcgtgccactgcactccagcctgggtgacagagcaagactttgtctcaaaaaaaaaaaaaaaaaaaaaaaaaaaagaaatggtttgtgtgatgataaacgagatcttaaaatatgttcgtgcataccttggcatctgtgcatggagtttgggggttcaattcattgctattgcctgaaacatttttaaaataagttttggaaagtttcatgtaatatatttttcttcagaatacttacttgatccactatttcactaggagagggatgaaaaggaagagttactacttctactctgatttgatttgagcctggaaagatgttttaagagcagtttctggccgggcacggtggctcacacctgtaatcccagcactttgagaggctgaggtggatggatcatgtgaggtcaggagttcaaggccaccctgtggcaaacacggtgaaaccccgtctctactaaaagcacaaaaattagccgggcgtggtggtgcgcacctgtaatcccagctactcgggaggatgaggcaggagaattgcttgaacctgggaggcggaggttgcagtgagccaaaattgcaccactgcattccagactgggtgagactccacctcaaaaaaaaaaaaaaaaaagcagtttctattgtttaatctatccttgtgtttcacaccaggaaaagtaagtgggagaatcaagcatttattacttccaaagtcttacaagataggccaagatatataaatatttcctagcaaaacagtatgacctgcactatcactgcttctagatactaacaaatgacaggttactctgaagccgtactgtacagtttataatgcatttcacacattcagcttatttcatcctcactgccatgggagcaggtatttttattcctagtttatagaggagaaaactgcttatgccaagttaaatagcttacaggagaccacattaatactgggtaatgactacttttaacattttgatgtatttccatcccatcatttttcagtaaatgtaattttcctttataaaattgagataaaagttaaacaattttgcatcttgatttttcaccattagtctttcctcataccattaaaaattctttgaaaacatgatttttaatggctgcatactattctaagttgaatatgtatcaatttattttgtcatttcctgttaggcatttaaatagctttctattttttgctgttataaataatgctgagataaacatccctgaacaaacatctcatctacttaaaaaagtctcctttgaattactgaaaaactaagttaggctgatcttcacttacatttttttttttttttttttttgagatggagtcttgctttgtcacccaggctggagtgcagtggcatgatctcagctcactgcaacctctgcctcctgggttcaagtgattctcctgcctcagcctcccaagtagctgggattacaggcgtccgccacacactgggctaatttttgtatttttagtagagacggggttttaccatgttgtccaggctggtctcaaactcctgacctcaggtgatctgcccgcctcagccttccaaaatgctgggattagaggtgtgagccaccgcgccagcctcacttacattttaaatgtgaaaactaagttttattttcatttttcctttagttaaatcattgacatgttatcaccaggactgtttgttcagatgatgtcacctttgaaactgctgtgcctactaagggaatggacattaggtcattgaaccaataaactggaatttgctgggtaaaacttttcgtatctcaggctatttttccagctatggatgggatttatactcctcagggctgagatgtgcttgaaagcacactgctgtctacccactgccattacctgtaagttgctccactccaccttccatgctgttttgggaggagggtgaaagaaagggaggggaatttcactagaatcaaatcagtttcttacagttctatttgttcttccagtctttcagtcatgcaatgactatttattgagtgtttttgatgttgtaacttgtaatttaggagtatgacaacagactttaggttgtaaactctttgatctgggagtactgtaaatcgtcatgaggaggttatggaacacagcatatcccaaagttacttgactatggaacccttttattttctttgaacacttacgaatgatctcccacaactgcattccacagaacataggttaaaggaaaaggctaaaaggcatctaacaaactccatatccattttgtttttttctccaaatagaatcatttaaatgaaatccttttaaaactagtaatagataatttcttaatgcaattaatttatagataagaagccaccagctgacataatctcttaaggtgaaataacataggcaataccattaagattagaagcttgatatgaatgcctacttcctggtattatgaaatatggaacagaaggggagacaaagtaatcatgaaggtaactgatacagttatctatctagaaaacctaagagaatctactgacaagctgtcagaataacttcttgagtcaaatgaccagatataaaacaaaaatgtacaactcagtagcttccttacatatcagcaataccctgccaaaaaaaataagagaaataaaaagcccattcataagagcaacagggcataaaatacctaatacattaataagagctccataggacctgtatgagtaaatcaatcacttttccaagaaggtctgcgttaaagcaatggtgagctgctgcttgggaagagcaaatacaaaaatgtaacttagagacagaatgcagttccaggacaaatggatcccagtgggatttttttttgtttgttttgaagaacctaactaagaaagttcttctcaaagaatgacagaaaatgagaattgatagcatttgaaaaataaagagtaatgcacgcagaagagtcttgagctaaaattattaaaaagtatttcaaagtgacaatatttaagatggtatggtgttggcataagaatttacaaacagaataacacgagacaaaggtcctaacagactcaatatagtatttaataacttagcgtatgaggaagcctcatgtgacagcagaaaaaggtagatttaataatagtgttagaaaatgacaaaagacaaaaaaaaaaaaacccacaacaatataattgagacagattttacttccaggtgggttaaaaagttaaatatttaaaaagtaatcctattttaaaaagagcgcccggccagccgccccgtccgggagggaggcggggggcagcccccacccggccgccgccccgtctgggaggtggggggcgcctctgcccagccaccctgtctgggaagtgaggagcccctctgcccggccgccaccctgtctgggaggtgtacccaacagctcattgagaacgggccatgatgaggatggcggttttgtcgaatagaaaagggggaaatgtggggaaaagaaagagagatcagattgttactgtgtctgtgtagaaagaagtagacataggagactgcattttgttctgtactaagaaaaattcttctgccttgggatgctgttaatctatgactttacccccaaccccgtgctctctgaaacatgtgctgtgtccactcagggttaaatggattaagggcagtgcaagatgtgctttgttaaacagatgcctgaaggcagcatactccttaagagtcatcaccactccctaatctcaagtacccagggacacaaacactgcggaaggccgcagggtcctctgcctaggaaaaccagagacccttgttcacatgtttatctgctgaccttccctccactattgtcctatgaccctgccaaatccccccctcggagaaacacccaagaatgatcaataaatactaaaaaaaaaaaaaaaaaagaggcagggcacggtggctcacgcctgtaatcccagccctttgggaggccgagacaggcagatcacttgaggtcaggtgttcgagaccagcctggttaacatggcaaaaccttgtctctactaaaaaatacaaaaattagccaggcatggtggcccatgcctgtaatcccagctacttgggaggttgaggcacaagaaccgcttgaactggaaggtggaggttgcagtgagccgagaacgtgctactgcactccagtgtgggtggacagagtgagagtctgtttcaaaaaaaaaaaaaaaaagaatatgagtgaacatttcctgagtcttaagataaacaaggattttctaaccaaaaaataaaagatattataaaaaaggaaaaattgttagatttgatcacaaatattaaatatatctgcatggaaaaactattacaaaaattacaaggcaaatttcaaactggaaaaacacttttacaactgtgacaaaggattgatatctgttactgagaaaaacatttacatttatttataagaacaagaccagggccaggctcggtggctcatgcctataatcccagcattttgggaggccgaggcaggtggatcatgaagtcaggagatcgagaccatcctggctaatacagtgaaaccccgtctcttctaaaaatgcaaaaaattagccgggagtggtggtgggcgcctgtagtcccagctactccagaggctgaggcaggagaatggcgtgaacctgggaggcagagcttgcagtgagctgagatcgcgccactgcactccagcctgggtgacagagtgagactccatctcaaaaaaaaaaaaaaaaaaaaaaaaaggacaagaccaacacttcaaatgaaaattggacaaagttcacagacaattcagacaattcacaaagtaatatggaagacaactatattttataagttcaacgtcactagtaagaaataaacaaattaaaataagtctgttctggctgagtgccccatggctcacgcctataatcccagcactttggactttgggaggccaaggcgtgaggatcgcttgagctcaggagtttgagaccagcctagacagcacagcgagatcccaactctacaaaaaatgaataaattggctgggtgtggtggtgcaatgtacctgtagtcccagctactccagaggctgaggtgggaggattgcttgagcccaggagtttgaggctgcagtgagctatgatggcatcactgtactccagcctgggcaacagagcaagaccctatctaaaacacttttttttcctatcaaattaattttaattagttttactggcagtttggtgaattactgatcctcatatttctggtgggagtctaatttggaataactgtcctaaaaaagaaagatagatacatagatttaggaatatatataagcctgaaaaaaaaaaaaaatatatatatatattttgagacaaggcctcactcagttgcccagactggagttcagtggtgcaatctcagcttactgcagcctcgaccacctgggctcaagtgatcctcccacctcagcctcccaggtaactgggactacaggcatgcaccaccatgtccggctaatttttgtatttttttttagagatggggctcaccatgttgcccaggctgatcttgaactcctggagtcaagtgatttgtccaccttggcctcccaaagtgctgggattacaggtgtgagctgctgcgcccagcctattatctatattttttgaggcactaatttatgcttaggctattctaagaaaaaaactagaaatacaaagatttatggccaaaaatgttcagttcattgcaacattatgtataacagcataaaaacagaaacaacctaaatgtccaacctgtactatagattatgatgtagtcattgaagttatttttgaagactatataatgacataagaaaatgctcatcgtatcatattaagcaaaaaagaaccccatttattaaattatatttacacaatcctcagttttgtaagcatgaattctatgtcttcatctaagtcactgagagaaatgtgaacagatggggtttggaacggatggaaggttcagcaaagtcagcctcccttttctgggttgaggctagccctcttccattcctccattaactgaaccttcatctggcaatggttcccaaatgtttcctaggggagggcacataagaattactgtgagagatggtttagaaaaacaaaaacagattttggagcctgacccacagagatttcgactcaggaggtctgaggtggggccctggaatccgtgtcaaaaggcctccaagtgattctgatgcacagccacgtgcagaaggaaccacggccttctggttcgaggttttgaaaaggacattgaacaccttttgtaagtcagcttctgaatgtgagttagggaagataatgtcaggatggaaaaagccttccccctcctacatttctccaaatactctgttgctgcttgtcaggtggatgatgtgacaactggcccagctgctggcctgcagcgcttccctgctcggactgcagctgccagcgctcccctgcccaccccccgccccacctactcacctcctgcctacccccaccaccccacccagccccgcctaccctgcagctccttgccctgctcttcaggacttttgctccaagtcttgcctcctctttgtcttctgagatgccagctgctccctctccatggcttcccttctgtccacttttcattctgctgaggttgtgcttgtctttacccaaacccctgtgatgcttgtggccaggcctccttcccccaggcctagctgctgagaatttgacgcctcacatcccactcattcctcaacccgcgccatctggcttccttcaccaccactcacaggcacacctcttggcaaggtcacctggctcccaaaggctaatctactggttctgtttcagtccttttcctggaagcatctgacactactgaccaccacctctctccctggcttttgtgggggtcatcgttgctttacttgcctcgtatccccttttcttggtagcagcatcctcaggagctgccttccccagctctcaggccacgtggttggtggggctgacctccccactccccacatttcatgcccctgcccctaaggattggttcagggatgggcatatggtcagggtcaaaccaatgagactcaagcctgagacttttactggggctgctgagccagcagaattcgaggctggaaatggaggtggccgcctgcccacccctgagaaggaacacaacatgaggagggccacagagccaacagagtcctggtgtgtctcctgcagtcctgggccaagcctgaagcttgcacatcctggtctgatgggtttcaggaaaacgttcttatctttttatctaagctagctttggttggatttctgtcacttgcaacctaaagagatctgagacagcactgagccactaccctcccaggcaattacccacctctttggtactttccccggagggtctccacaagctctgcttcctctcacttaagagtcctgtgcaaggacttctacttcccagatgctggctactaaatgctgacactcccaagtcaacagaccagcccagatatctccctgagctccagacccatgtcttacccctcatggacatcgccaccttggtgtccactcaaacatgacaggtctaaatctaaacttatcattatgccccatccttcctcttcttggatccccatctcagtgaacagctgtactccccagttaccccagaaaccgaggcctcatgggtgacacctccccaccctcactccctggccctctttgggcagctaattctctgctcattcctcagggctcagcttttaggctgcattctcagggaggcagccttttccaacccgcaagcctgaatgagggggtccctcctatgcccccagccaccctgtgtttctagtgttacagcccttgtcactcagagctgtggcctgttgactctcttctgtgatggctggccccaaccctgaaatcaagatcatttgaataaatgaacactagcatctgtaggtgtgatcttatattgtatattgaaaatatagtctaattttctgtaaaaattaaatatctcaatattttagagagatctgtaaagggtataatatttggaacagaagattgattttcaggagccccagtatctggatgagtgtgagaaccactaaataggacccatagtttttctgtgtgagattttatttttttaaaaatagatgaaccaggctgcctattagtgaatgccttcacttcccttttccttaattactgagtctagaaacttatcaagggaatgaagcaggcctttgttcctattcagaatccatttccctgcttttttgaaaatgagaacatctgcctgcttccagtgttccaatacttttcatattcttcacaatttcttaaaagccaccaaatacagttctttgagcagaaatgcaagttctttcatccatgtgtccggccagagatttcctgaacctcgcctgtggcaggccctgggagagctcctcagcctgtggttttaatcccctcttgaacacagctgggctcccttctgccatctctggggcattttctttgaggaaaaggaggaagctgagtagttctgctttctgttaatattgcagcaagagcccatgagtgggccgatcacttcctgattcttgttcttgttctaatcataccttaaaaggcttttttaatgtccaaggcacttttaccttctcagcccactccagcttcttgatccttcataccgcccataaaccttgtctgcacccttgcacatgcacccctgccccttttttcccctattaaatactatagttaaatgttaatatctaaagtttttaaacacaattacggtatcaagcattttattaaaaatttttatcatactttgattttaccaacttgagtgttatgaacaatgaacatgtttatacattgacaagaatactcatacagggattgtgggatggctactttcactcccttttccctcatctttactcctttttttttttttttttgtagagatggggtctcactatgttgcccagggtggtcttgaactcctgagctcaaacgatccacctacctcagtctcccaaagtgttaggattacaggtgtgagccactgcacctggcccctcatctttactctttagttcctttgcccttgggttcttctagcttatttctactttgttttctttctggcatccatttctattttaaattattacacatagatgcagaaattacttggctggcgctagttgcagaatcatgaaaattaaatcacatgatgcttagtgttgaaagactgaattgttttggttttttattgagatataattcatataccagaaaatttattcttttacagggtgcactcctttagtatattcacaaagttgtgcaaccaatatcattatccaatttcagaacattttcatcacatcaaagagaaactccacgcccactaacagtcattctctatttcgtttgcatgcggctatccagttgtcctagcaccatttgttgaactatagtttcccccattgttctaatagtttttaagtggtttcttaggattctctacatagaagatcatgtcatctgcaaagagttttacttttttctctccagtctgggagtttatttcttttcttgccttatttccctgctctctacccttttaaagcctatatagtttcttgagtgacttccctcttttttcctcattagaataagttttctggggagagggaacagagcatatgaagggagaaagtggagctcttaaaaatgtgtagtttgggatggggcgcggtggctcacgcctgtaatcccagcactttgggaggccaaggcgggcaaatcacctgaggtcgggagtttgagaccagcctgaccaacatggaaaaaccccatctctactaaaaatacaaaattagccaggcgtggtggcacatgcctgtaatcccagctactcgggaggctgagacagaagaattgcttgaacccgggagggggaggttgcggtgagccgagatcatgccatggcactccagcctgggcaacaacagcgaaactgtctcaaaaaaaaaaaattgtgtagtttgcattcatttcaaatggacttcatactttttcagtggaaatgtcttccttcacagcacctggggccagggattttctggaggaatctttgaaatctgttttcctcaagttttggacacaagcctgggtgagctccatatccatccttcctcggctagtacagagtctaagatgacatggtcactttcccccatgcccatctcccctccttctctggccaattctttattgccagtcaaaggcagaagagccaacagcaataagagaagattcccaccatgtcagcacaggttctgtgtcatcagtgacctcttggaatgtgcaggaagccagggagataagaatctatggctatgtagattaggtacaccccacagccaagtatgagcttctagggcccaatcgctagaagcaaacaacccagaccactaaccaggctctaactaaggcaggatccaggatgctcagcaccctgggccaacccttccgctcaagatgaatccatggttcatttacagtgtctggggtgatatttaattccaagttcacaagtctccagggtagctgcccttttgtttggggatttcctcccgggtgctaaatcacttcctcctagctccaatctgaaaagcaattcaggtctcctgtggcctcaccaagcttcctgcccacactgattttcttctaacctcactggtctaccttgtgtacatcacctaacaacaaagccacttagctcaaggaaagcctcaagaacaaatggcttcctaataaggtgattcctccctcaccctagggtggcccacagctccagcacctgctgagaggtggccaatttggatgaggtagctgccaggaatcaaatctcagaacccttcataaaactgcgcttagctattccacaaatttctccaaataatgaaacagagagaagagtgagaatataatgagagagaaatctggaaaaatacaaaagataaattcatgttcctgtgagttgtattcatcttcctgggagttgataatcaggctggctagctatccagtctatgggagcagagagagggctgcattatctccaggttggcacagcatctagcaggggctccctgatgacacctgggcacaacaaggacctcacagcaaagacaaacaggaggaaatgcctagggtgtggggacatgccaccactaaattacaaaaatatatgcctttcttctttgtatgtttcaacagtaccgcttcccactcttgtaccacttggccataacactttattatccctagtacctaaaaactagacagtattactgagaccttaaatgtgacatttgtcatctttcaaggtgccagttactgtaatacagctatggttcattttgagtgtctgggtgacggtgacatatttaattctatttttgtcttgtccataagcaccaaataaagcaattttgaaattactttcttcacactcaatttattatctagaacgacatttcaatacacagtatatttgttttgtggaattcattcgcagtgtatctggaggcctggatttaacatatttcctgtagtgatagctactctatttgtaggaactatttaggtcactggagtggagaaaaagaggtcgctacttaacagaaatggcatgtatccaaatatagatgcagttttctcaacacctgttgcacatcaaatgatgaagagattgttacaatttccaaaaccctggaccaaaaccttaaatgatcagcactttgtttcaactgatacacggcttaagtcagaaaaataagttcttcttaccaaaaacagtgagcctaaatatgctggctgctttagaaataaaacaggtgatcaacaaagcaatctgtttctgtctaaataatttcccagcaaaagtcacttcttttgaaactatatgatttgaaccacagggtatgcacagtgattgtgtgctttcagaaacacggtaagcatgacaaatattttcagttgtcaagggtaagcgaggagggaatgacccacctaagaaatggaaactaacaaatagtaatatgacactcccccttagttccacaggctggtgcggctgctacacgcagctcacttcctacgggcggctaaaggcggtgcatgaactgaacgtaggcggcctctttatcccctccccacaacactgtggggtggcacgtaaagacctcaagggaagggggcctgggcgatacgctctcctgctgccattcatttgttcaagaaatagttgaacaaatgaatagttaaacaaactctccaactaggactctgtcccattcggataccctacgcctctccccccatttccatccctaggcatcactccctcgtcaagaatatgctgattatggctcgcgccccctctctcccttggaccctcccgccagggcgaccggacgaggccagcgggagcaacgccttccgaaccgcaaggaaggagggctcggagtgcgcagggcgcgggttcgcgggaccctccagcgcgcggggctggccagccggggcggggccgagggcaccgggcgccgagctccgggaggggtccccgaggtcgcgccggccgggaggggcagcggcgggaggcggccgactgcggcgcacacgtggggagggcggagcggggcgggagccgggcgaggggcggtgacggtacctgatgaaggtggtcttgccggtgctgtactggcccaccagcaggatcatgggcttgttctcgaagtcggcgtcctccagcgcaggcgagtggaactcgtggaagcggtacgcctcctccagcggcagcaccttgcgcaggtagagcgagcgcagcccgcccgtcaccgtctgcaccgcgtccgcgccgccagcgcgttcgcgcccgcccgcctgccgccccatccagctgaacatcctgccgccagtccacgctcggatgggaccctgctccgggttcgactctccccggctcgcactgagccgccccggccgcgctggccgccgcccgaggagggccccgccttgtgctgccacagccagtcttcggccgctacgtcacgcgcgctcgcccactattcagacgagctctctcaggtccttcctgattggatctctgccagagagggctgaaggcgtcagccaattgagaggaggttcttaatgaattattgatgacggagtcattctagaggactgggcggggagatggtgtcttcccggccgggtggcactgaccggtcatgctcagggcccccttctggttgccggtgcctcacctctggccaggtggcatcggcttccgggtaaatctgagctgcccaaagcgagcctccggaggctgctccatctcctggaacgtttactcattcaggcctctggacgtcgatactggggatgaaaagttcagaaagtggacaggcaggttctgtcttcccgggggcgggtggttatgactccgttttacaggccaagagacccaggctcacgggcataattgacacaatcttgaggggaagtggactggaatctatttgagtagccgtttctcctacttctccacattgccctcactaaattctggatcagctaaaggctttttccccttagttttctttatgtgtttttctgtaaagccgaaaatttagtcattactctcattattacattatcctcattattacaactttatttccacatattgacatgtgagtcattgtcacctcctagctgttttttgttgttgttgttgttttctgagacggagtctcgctctgtcgcccaggctggagtgcagtggcacgatctcggctcactgcaacctccgcttcccgggttcaagcaattttcctgtctcagcctcctgagtagctgggactacaggcgctcaccaccatgcccagctaatttttgtatttttagtagagatggggtttcaccatattggtaaggctggtcttgaactcctgacctcagatgatccgcctgccttggcctcccaaagtattgggattataggcgtgagccaccgcccctggcctgtttcttttctaggttaaaaggatactcacttatctaagttgagattgggggaaataatcaccttttgtgtccttgattgtagcttaggaatatttcttagttgttttagagcatttctcaagtgtgatccatggggccacctgcatatatgcatttatgagctgggatgcttgttaaaatgcagattcctggtcttcagtccagacctactgagttaaaatattgaggagagatggagctcaacagatgccctaggtgactctgatgtggcctaagtctggggaaacagtacaccctgcagtacttctccaacctaacagaaatgcggattctgattcggtaggtatgggatggggcccatgactctacatttctaacaggctctcgggtattgccaatgctacccatccctggaccatacttggagtatgagagaacaggactttgcatcaaaagatctgggtttgaaccttgactatgtaaattaatggctgtgtgattttaaatgtgatgagttacctctctgccctagtttccttaagagcaaaatggaaactcctttggagttgttgtgtgggtcacatagttggagggaattgtatgtaactagggaagtgaaaagaaagccaagggaaaataaagttagacatctgccttgtgtcaaaataaaacaaagattgaaatgtaaaaagaaaatgaaaccactgcactactagaagaaggtacaagagatttatacaatttggcggtggaaaagcctttctaaccaacattaaggacagaaattatgaaagcaaaggctgacatatttgacaacaaaagtaaaagcttcgatgtatttttttagaatacataaaaacaaacggatataaatacaatcttaccatatgatgcagaaatcagctccttagtatttacccaaatgaattgaaaacttatatccacagaaaagcctgtacatggatgttcatagtggctttattcataagtgccaaaaattggaagcaactaacatgtccttcagtaagtgaaaggataatctgtggtacatccagacaatggaatcttattcagcactaaaaagaaatgagctatcaagccataaaaagacacagaggaaacttaaatgcctattactaagtgaaagaagccaatccgaaaatgctatgtactgtacgatttcatctttatgacattctggagaaggcaaaattatggaggaagtaaaaaggtcagtagtttctaggtgttagggagaaggaaggaatgaacaggcagagaacagaggatttttatggcagtggctctactttttatggtactataatgatggatacatgtcattatatatttgtcaaaacccacagaatgtacaacaccaagagtgaatgtaagtgataatgactcgtgaatttcagatcagttttaggttcacagcaaaatggagcataaagtaccgagagttcccatatacccccaccctccccgacacacagcctcccccactatcaacatcctgaaccaatggaacattcgttacaatcaataaacctaacctaaatagatacatcactaaattaacttaaaatggaactagatataaaactaatataaatgtagaactaaatgtaaaacttaagattataaaacttctagtagaaaacacgggagaaaattgttgtgaacttgggttagggaaagatttcttaggtgacaccaaaagcacaatccttaaaggaaaaaaaagttggtaaattggatttcattaaacttgagaacttctgacctttgaaagtactgtgaagagaatgaaaagacaagacaaggcacagaatatacttgcagatcacatatctgataaaggacttgtatccagaatatttaaaaacttcttaaaacttaatagtaaaaaccccaattttaaaatttccatttaaaaaatggaaaaaagatctaaacagatattttacaaaagaagatgtatggatggcaaataagcacatgaagacatgttcaacattgttgtttgttaggagaatgcgaattaaaaccacagcaagatactaccacatacctattagaatgtctaaaattaggaaagactgatcatgccaatcattgatgaggatgtggagcaactggaactcttacacattgttggtcagaatgtaaaatggcacaaccactttggaaaacagtgtggcagtttcttaaaaagtggaacgtacacttaccacatgacccagcaggggaggagcagagggaaggattgcaaaaggcactggaaagcttttggggctgaagggtttattcattaccttgattgtggttatggtttcaccattgtatacatatgtaaaaactcatgaaattatgtacgttggatcctccatatctctgtgttctgtatccatggattcaatcaaccacagatggaaaatatttggggaaaaaaatggatggttgcatctgtactgaacacatacagaccttttttccttttcattattccctaagcaatacagtataacaactattttcatatcatctacattaataataagtaatctaggtaggatttaaagtatatgggttcctgatgcatggcgttttaagtttaaaagaaagtatgtggaggatgtgcttaggctatatgcaaatacaataccttttttttttttttttacaataccattttatataagggagttgagcatccatggttttggtattcccaggggtcctggactcacggataaatgtactttaaatatgcacagttgatcatatgtttattacaccttgattagttgttaaatatggtcatactttttgactcaggaatttttatcttgaggaaatttatcctgagggtatttatactgaggaaatgattaatgtaaatttttatctaagacgatggttgtcagcatggagctgtctatcatcatggaggattagttaagcaaattatgggttcctatgtggttactgaaaactatgtcatttgacaagaatattaatgatgtgcaaaaatgctcagaatatatttttaagtggaaaaaggctagattacaaaagtgaatgtacatgcagctgctagggaaaacaatatggaggttctgcaacaatttaaaaatagaactactggccaggtgcagtggctcacgcctgtaatcccagcactttggaaggccaaggcaggcagatcccttgaggtaagtaaggaattcaagaccagcctggccaacatggcaaagcccatctctactaaaaataacaaaaattagccaggcatcatggcgggcacctgtaatcccagctactcgggagtctgaggtaggagaatcacctcaacccgggaggtagatagaggtcgcagtaagctgagattgtgctactgcactccagcctgggtgacagagcaagactgtctcaaacaaaacaaaacaaaaactaccatatgatttaccaatccccaatttgggtatatatttaaaagaattaaaagcaagctctcaaagaggtatttgtctacccatgttcacagcagcatcattcataatagccaagaggtggaagcaagccagtgtccatcgatggatgaatggataaacgaaatgtaacacacacacacacacgcacacagaggaatattattcagccttaaaatggaagaatattctggtacatgctacaccctggaacacggatgaaccttgaggacattatgctgagtgaaataagacagtcacaaacagccaaatgctgtatgattccactcatatgaggtttctaaagtagtcaaattcacagaagcagaaagtagaatggtggttatcaggggctggcgggaggggaatggggagttgttcaatgggtatagagttttagttttgcaaaatgaaagagttctggagatctgttgcacaacagtgtgaatatgcctgaaactgctgaactttacacttcaaattattaaaacggtaaatggtgtgcgtgttttctaccacacgtcttttaaagtggacgtacaggatttttgtacttttgttttaaacagtttaaagtatctaagaaaaagatgggaaggaaaaacccccaaataataacgatgtctgagttttggactggtaaatgatcttagtttcctctttataagctgtagcatttttcaaatgttacacagtaatcacgttcctgttataaaagcagaaaaaattatcaggaagaaaaaaatgtactgtctttaatcttaaaaaaaaaaaagaaaagaagagaaagtcctaaaagcgcctggcccagaggaggcaccagtcccatcttgcttcgctccctgcttgccttcatgcagttgcagctttcttatttattatttttgtaggcacatagtaggtgtgtatattcatggggtagcagcagcttaatttatttttgtgggcacataataggtgtgcatattcatggggcagtgacagctttttttcttatttattttgtttttgtgggcacatagtaggtgtgcatattcatggggcagtgacagctttattttattgtttttgtgggcatatagtaggtgtgcatattcatggggcagcggcagctttcttatttactttattgtttttgtgggcacatagtaggtgtgcatattcatggggcagcggcagctttcttgtgcttgctctaccctcaatgaagccagacagtggcagatcctccccgccatagtcatgttgcatctgtttgcaaatcattctgctctttggttttctttcttcagactaaacagtcccaattgcagtcactctttcatctgaatccagttgtttttcaggtcaaatcctatcacaggcagttctacaagggaatgccactagttgttcggaaatctattgtattgaatgcacgcttgaaattaggaagctggtaataatggtcagaagatttgctctagaccatgttcagtggttggctttaaatggtgatcaagtccagtgttttaccctgaaaactggattgcagagtggttaaaggcctgggagactcgtgctgagaccagaggcagtgctgtggcctggtgctctcacacgctgatggcctttctctgtggccactcacccaagtcactgccaccacccagaggaggggcttataggacacacaggtggagatggctaggaggtacttgcaggaagtctgctagctgcgtataaattgtccttctttcgcagcagaactctgatttttaggtgggcatattgccacccatgcaaaaaacaaaaacttccagcctccctgcagttaagtgtgatgatgagaccaagttctggttggtgatatgttagctgcaggatgtgtgggacttccaggaagtccctttaagaaggagttcaatcttttttctccttccttctggtggcctggaatatgggtgtgatagctggagctccagggcttaccctggaccatgaagccaaggaccacataagggtggataaagcaaagagccagaagaagcagggtccctgacgaatcgtaggtgtgccttgaactgccttcctgtggatgtcttttacatgagtgtgtttaagccaccatttttcagaaataaacatgcaattcctaaccaataatcaatttgttaccagaaatggagtctgccacaacggaacctaaaatgtgacatgtgctcagcggacaagggggaaggtcaatattaaggattcaaatattgtagctggaatttaaaatatggctgcacagttcttgacatgccctccatccagagatgggttcattgtcccctccccttgaatctggactggcttgtgactacttctgccaatagatttccatggaagtggagctacgtaacttctgaggctaagtcataatgggccatgctgctgccactgtaacagacactcttggaaccctgagtgccatttaagaagactgaccatcctgagtccatcatgctggggtcaccaaggtgctctgattgacactcctagctgggattgcctttcatctttcacagacttcccagcccaggcaccagacacaggagtgaaagagtcgttggacgagggcccttcagcccaggctgttcccagatcccaaccactggagtcctcaccagcagttcagatcatctgacctgtggccccaaacatggagcagttatgcccttttcaaattcctgacccacagaatctgtgagcataataaaatggtggttaatttatgccattatacattgagggcttttgatgctcagcagtagataactggaacagctggtaattcttactatgttaagataaaagtttagttctttttcacagagaagaagtccagacataggcagtccaggacaagtttggtcactttgtagtcagcaagaacgcagattcctttatcttccctgctgcctggaatgtggacatgatgggtggggctccagcagcaatattggaccagatggtaatcttgaggatgacagaagagagcagaaaggagctttggtctctgataatagagaaataactctctctcttgtttaagccactgtaattttagatcttcaggttatacggcaaaagcattgctaataggcacagaattggaattcatgggtttagaaccaggagattggcttggctaaagctaaaaggttaagaattttcaaattagaagcagtagttgaagtcctgggtataaatgaggttgcttaaggagagtacagagtgagaagaggaaagagctaaggagcctcgaggaatggcagcagttaaaagagaggccagaggaggggctcccacctttccaggggaagaaacccgagacagaaggtgttcagtgaacacgacttcttcccctctgtggctgggttgggagcccttcctatgcctcttctggacacagctaacatgcagctttctcttcatatcacaagggctctgttttacatgagggcctcccacatgggaccagaaggaacctccttaaagtttggaatcaattgttaattcttcttgtggccccagtgcctacaacagtgactggcatgtaatgggcaggcagtagttatttgcaagctgaactgaattgaactgcttttggcaaggaagtcctgggaagggaaggtttccagaaggagggagtggtctgcggtgcaaacactgagaacaatcaagtcagataaggcctttacaagactggtgggtttggctcagtgcatctggcaatgaggaggccattggtgaccttgaggagaagtgttttcgtggggaggcagcggggacagggtaactggtgtgtgggagcgggtggggtgctggttgctcttttgggaagaaagggtggagacaaggagggacgggtttcattcattttgtcaatttcatcatcttcatcataggcagagagcagggaactgggaagggagcctcccctgacttctgcaggataccatgtgcttgccctgtcagagttgatgacacttttgtcatttccttagccaactcaccatttaacttctcatgtatgcataacaatcttttcatggttttctcccgaaccaaaatgtaagttcctggaaagcagagactgtttacagcttgctgtgcacaaagtaggtgtttcgttggtgttaactgcctctgtttcctctcaagcaatgtttcctgaaatatacctgagcttggaacagcatggatctgtacgagctggtgccccactagttgatgacatggcttcatgaaaacagaggagcacctcaccactagaagagacccttgcagtaggaaacaaagctgcatgagaaaaggtgggatgggatggaaacggcctactcactcccccaggagtggagaggaggaagcctgaagggatgagggcagggttatgcatattttgcagcatcagataatgaaagcagatgagtcagcagcattcacccacatggccattttattccatgcacaaataatatgatgattttataaacctcgtttcacaaacttttgatgaatccaaggcatggctgccttcgccttacgataaacaagtcctgtctgttgcttggctcactctttgatactggaaggagagtctgttgcagtcagaaagaaaagatgtcaaagtggaggcagccagttgctctggtggaggggagggctggtgtcccaggttagcattacctggatggggaccagttttgcaggtccagagctcagtttatcagtggctcaagggagcactgattcatacgttccaagctcatgggagggagtggcgtaaatccaggcctctcaaacttcaatatgcacaggaatcacggggggcgcctggggatgggaatctcctgaaaaatgcagcttctaatttagtacagctgggctaaggcctgagattccgcatttccaaccagctccccactgcactttgagtagcaaggatgtacatcggaggccaatttttctaaacttttggtacctgtcaccactggtttcctcacaacccaaagactgcttagggagcatggtggcccagaaaggggactccgccttccagggttgctgggtttcctgcagacctcatgtcttcctgcctttctgctttcaccttctatcagcctgggcctgtcagtggctccggttatacatttccttggttatgttcccagcctgaagggagacctgctgactttgggtttctctgtgtcccagggttttcccagagattcattaggaagcaatcttaaagggcgggcttcttcctctgacggctaacctagtcctttttcactaattcttcccagtttcagtctctgtgggtgactctccaagagttggaatgcactggtcacggtgttgacaacacagataagaggaatcacatttagaaataagtaatcccatgaggcagccagagagatgggcagtaagaggctgagagatgctcttggagcagggtcgtcagtgagcaccgacagctggagtgggcagcgctggatgcatcgcctgcctggcccccaacctcatttacccacagcctgcctgaccttgctgaactccatcccagatcctcatttggtgaacctgggctatagacttaggctttgcctggcatttgtttggagctggatgcttgggcatggctgtctggtcatgatgacatggatcaccagccctggagctctgggtagctggagagagccactgaaaccggccacctatttggctttgttgtggcagagactggcttatttctagggctccatctagatcttctagcttcatgcttcctattaatactccgattcataaaaataaaaatcatgaaatataattgcctataaaaataatgagactagggccgggtgcgttggctcatgcctgtaatcccagcactttgggaggccgaggcaggtggatcacctgaggtcaggagttccagaccagcctgtactaaaaatacaaaaaattagctgggcatggtggcgggtgcctctaatcccggccacttgggaggctgaggcaagagaattgcttgaacctgggaggcagaggttgcagtgagccgagatcgcgccattgcactccagcctgggcaacagagtgagactccgtctaaaaaaacccaaaaatcacaagactagaattgccttaaattttgaagtgtttttccagtgaaacgccgagtgcctctcaggtccttctgtgcatttccctaggcccgccacacgaggtagaggacagagagaggagggctgccagccctgggctctgcctctgagtcgaggtttctgggggcccagcctcttccccaggcttttcctctccacagatgtgtgggagcctgtggctatgagaccaccttctctatagggaagcacttgaagaaactctagtgggtataaaaccccaacagagctcctctctctctctttctgactttctcaactttttaaaattttttacttttcgttagaaagcccaggccaacctgctcacacccattgccggagagcagagctggctgcgtagtaacctggtcagccctgaggggtcctgcacctctgatggtagaagctgacacagaacaggggaggctccctggggcctaggagggacactggcccttcaggcgcttcttcttctccactgcgagccgcagagcctggaggagagtgtccttattattcaggatgttatactctgagagtttcaccagcttgtcaaaggtggcctctgtgtatgtcagctccttggtggcatagggagttttgggaccataaatgtccacctggccctgctccagctcctcagggcttcgctctacacctgtgggcagcaggatgacttgttatagactctgtcatgttaggttggaatgacttgtttccacatctctccccaaggcccaccaacctgcactcacggacacacacacctgcatgaaaacctgtacacacgcacaccctcacacacgcacctgcacacctgcaagctcctcagggcgtggtgcaggcttgcccattggaggattgccctagcaccaagcacagtactgggcacatggctgaatgtcagaaaatgtagaatgactgaaagaatgggggatgacactaccagcccatgggggtgagggaatgggaggcgcccttctttgtggaagccaaggttggctcaggctggagctgagccaggcttccccgttagtgcccttagagactctacagatctaaaggcattcccgggccaagggcagcaggtgctgggaactgagcacagaggcagctcacctggtgccttgtattttcggaaagtgtcattgatgagtgggaagaaagtcacgatgggggcatcgggttcctgggggttctccatcaggtagcattccttgagattttcattctcatctggcagctcgtatttggggaaggggatgttctgcacagtgcagtactcacaggtttgtttcaggggctggaacagcacagagggcgtgtttgagcattaggaggagtgggagtggaggagaagcacagagttcttagccccagcttcctgatttccccagctaacaactcagctccccaactgctttgccagtgtatggtattttgagactaaagccaggtcaggacaaaaggcccgaggcagtaggtggatgcacctccagttgcaagctgcttccccaagtaaaatggacaaaagccctttcgttggtgttcgcatccaaacacagacttgggtggatgtggtgggtagcctggaagggcgactggaaccaggctatacacagccagagctgcccaggcccctgtgggatgtgcatgggctttggagctgacagtagtacagggctagaaaagactctgcaagggcatctctaaaagcatgatgtcgcaggaagagcactgccttagagtgtcagaaccccctcagttctgcccctcgttcctctgctcactagctgtgtgatcttaagcaagtctctctgtgtcttggtttcctcatccataacatgagaaatgatagcagttgtgccgtctccctccaagagctggtgtaagggccaaacaagatcacacgtaggaaagtgcattgttacccatttacaaacttagattgttttcattgttgccctgttggtctgtgtacacttcacttcgcctggcttcagggtagaactgtatacacatagaactttccaaagtaaattaaaaaaataaaaacttctggttctgacaagtgccctcctctctcgccaggcttccctcccacctgagagcacttgagtgtaattcatggagggtcatataccctgggggaagggagagtgtgatcattttgaaaataggatattacaagctcttgaatggaatgggctctactaaggttatttttaaaaactcattttttgtagctgaagaattgcccaatatggcaaatgctccaaggcaagagtaaaattcgaatttgctaagtcaacatgggcaccatggtgtgagagccagctggctgcccgtgagttctgggtgtctgacttcccatcatgactgctgcttggcttcctctgatgctctctgggggctgtctagagcatgcctcttcccagttcacagcgagtgaggccactgactgcggggcccatcttaggagaggctgcagcccatgctcaggagggaggctgcgcacttgcctttgtctgggacccagcacagtagttgaggtggatgatgaggtcggcttttcgctctggcctgaggaggggcgggtagctggagttgacaaagaacgcagtgtccagcaggcacaggtggttcgcggactcggtcagctggtttgggaaaccatctagcactgtgtctgaaagccaagccttcccgttaccaacacacctggtgccctgacagccaatggacagaggcacttggggggacggagcgccctgtctggagcatccttcgcctcagcctgaccaggacgcccactgagttccagtgccctctgggtggctgaggaagaacagcgttatcttgggcttttagctagtcttttatgggatattgatacttgtggggtataaggggcttaagaccaccccataaatagtgtaaaccctgggccctgagtcagctgtcccattggccccagatggtgaggatgaggcttaacaggccaggctgaagcagccatttgcaggccacggccaattaaaatattaagaaggcgaaagtcaatgccttagggcctcagcagcagaggaggcggcactgagctgacgctgcaggaccacagtttaaggcctggctctgctgcttaccacttgggggttcctgagctgggccatccctgcccagttccaagcgggcaccactcacattttttttttttttgagacagggtcttgctctattgcccaggctggagtgcagtggcgtgatcatggctcattgcagccttgacctcctgggctcaaatgatccttctatctcagcccccaagtagctgggactacaggtgctcatcaccatgcccagctaattaaaaacaatttttttttaagagatggggtctcaccatattgcccaggctggtctcaaactcctggactcaagagattctccagcctcggcctcccaaagtgctggtgttacaggtatgagccactgtgcctggcaccactcacattaaagggcatccccagaacacaactgcagaaagtaagaccccctgtttccccatctgtaacatggggccaacttctacctgctaggactgttgtacagattctgtatagaatgactgtacagatgcagtgagttaagtacccacaccactccctgctgccagacacatacagtgttcaagacgacaccaccaaatgtggaaaacaccatggggagagaggtgcctggcccagtgaacatagccagagaagttttcttattctttatccatggcagccttgacatccacatcttcctcctccatatggaggcaggcctcaaggagtagccaggtagggttacctttccacctagagaactggccattctggaggtagttggtgtgcagctgcagcccagacaggaagttgtgaaactcagacacgaaggaccgatgggtaaggatttctcggaaagaattggacagccatgaccctgggatcactaccgtggtctccaggatgttagcatcacatttggggatttcaggcaggatcggctcgtcttctgcaggggagggagggatgaagggcaggtcatgagaggtggagtccccagattgcctatgcgaagccccacatggttgcctggcacccaggggtgagcactgtaaaagcagctcataccttccttgctgggctctcaaggtcctggcactggggttaggaggattcaggtgagagacatggagtaagcagagaggtagtagagagggagggggagcgagacagctaagaagcgtcctggagaggacagggagtttcaaagagtgacctgtgactgctatagaccctactctcctcacttctcctgggtgctggcagccttgcctccaggccttggcgctggtgtcactcacctacagtcaccctcccctccaggcagggaagacactgtagccccagctgccctcccacgtcttaggccataggtgacgatgcggaaacatgtggcagggggcctcatcctcggtttgtggtccacaccccgccccccatcacccagccatgagggaaagccgggggccgccccccatcacccagccatgagggaaagccgggggccgccccccatcacccagccatgagggaaagccgggggccgccccccatcacccagccatgagggaaagccggtgtcacccatcacccagccatgagggaaagccggggtcacccaccgatgtcctgcactttctcccttgtccacctgtggaaaaactcctccgaggtgtgtgacaggttccaggcatccagcaggttcagggagaagatgctgctccacaggcctgggagccagggccagcgtgagcagctccaccctgcagccccaggccccacactgacatttgattccccactccccccacccccccaccccacgcaagccaggctgctccacaggcgggacagacttcagacttccatgtccttctccccttcccactgcagctcaacacagtgactgaggggctcagctctcagctcttctcttccctcccctcagtgccgggagacgtaaaggtgtataaggcacagccccggcagggatttaatgctggcaagtgcaggctttgagtttaagtccagctgctgtcagtgaatacatctaaagcatttagggcagcacctggcacatggcgagcactcaataaatgcaaatgctatttgttattatgatttttaaatgtaggcattagacattgacccatttggaatctctataaggtgggttttactcttaagcctaattaactaaggagaagatggaggcttcgacaggtgaggcaatctggccaactttacacagctagtgagtgagaagccagagttcagagttcaagcccacgtgttttgcccacagttttctaaaccacatgctcatcagcataggtgttcaggggaaggagaggccaccgtgggctgggggcttctgggggaagaagtgatgggactgagttggatcttgcaggatgggttggtttgggatagacagaaggggaaggcacagacaactaatttaaataagggcgtgttggggctgtgaatgtgggtctgtttctgaagaagccctttgacgggcgcagctaagactctgaagggaagaactcgagtgggtcctgcattcggtgggcccagctcatgaagaaccgaggcgcttagggtgggaggctgggctaggcttctctggtgaccctgccccttaccctgtggtctccctggaccctcgggtcccaggtctgggttggcccctggaagcaggcacactgctggccgaagctagacgggagtgggtgggagttacagaagcttccgtctgagtctgctgttcccagtgtggtgctgagcaggctgcagggagactgctggagaccaggaaattgggagagcccccagaccaactctggtccccagtgacttgggaccactcctaggatgagacaatgctggcaagtgccccgagtgtcacataatcaggggccaacccagggtggcccagcactgggcagcagccccctgtcattccgccagttgcaaggcagtcacctagcatgtagcagattcgagactccgggatcctcttcaccagccgccccatgaagaactcggagccgaagagctcggaggggatgaaggccccatacttctgcaggcccacctcgtagggggagaactcgaaccactctgcacatgaagcagcaggacgggggtcagtctcaggccagggagccgtccacacagccgggcccccctcctgcctgcagccactggctcaggccttggaaagcctgggacagggaggccgcagttcccccaaaggacacatgggggcacccttggccagcttctgctggtgtagcaagggtcagctttgccatgctttgcaaggaggatggctcatttgcacctcagagcctgttgaatgggacaaaaactgaccctgaagcagggcagctctctcgagtctctctctctctgggcagcgtagaaatatcttcctttcacaacctttgtcttccccagtgtcattaaacacatgcccagggaagctgcagacagtgcctgccggcctcacccatgcagcagggcagattggggtagcaaaggtgatttctccagctgtgtgcacagtctggatgtagaggttgacaaagatgagtgggattgggggacctggaggtgctgggtgcttttgcccaccaagaagtccccccctccaccccacttgtaaatcaccagccactggtgttacctctgaagtcctggttgcttacatcatccttgacattgatggtgaggtagatgggcagggggttctggccgcagctcaaagcagcacgctgatctgacagtttgcattcatttctctgtggggaaacaaaatggttaaagagaagcagcagcccagagggtgagggaggcagtgcagaatgagaagacaatctggacccccgcagccacttcctggctcctgagctcaccgggctgctgtatcggccccagctgacaccagccaaatcactctgaaagggcaccaatggcataggcaccaccccctcgggctgcccaccaccagacaggggccgggactggatccgcagtttaggacagtctctcagagtcccagggtcttggtcttaggggtcagcagataaagaggaaggggtgggagaggctagcactgcccctcttctgccccatcgtcttccctctgctagaactggagcagctccatgtttagcatctccattttttaaaaaaaatcagcttggcatgttgagctccctcaactgaggggtaaaaagttgggggaaaagaagtttcccttcctccgctcccctgccctcccctccctccctcccctcctcttcccttcttttttttttttttttttttaacaaaagacttaggacttgaacactagatggttgctgaggtcactctaatccccagagtggggagcctttcagatcagcccgggccacagtccacctcccaaagtgaatcagccactgcaaacgaggcagaatcaaggtcttagaggcccaggctctgaccccaggccaagcagctgactcctgggtgaccaaccctggtcaccccagtgtgcaaaggctacagaacctgtgtggaatggcaaacacatgtatatgcccaatgacatgtgggtctcctttgaaagaaaacagggtcataactgggcccagagatctgggcatcacagagcccactgtcctggaagtaaagctgcaggctcagggaagagccggtccacattcattgtcaaggtggcccaagggaaaggggctcctgtcctggccagagcgcaagagcagaggcctctcaacaacaaccctgcccttgctttcctgggaacccagctccttcccaccaaacccccagaatgctgagactcctgatgtcggaagactcggtgcttcctcctcatcatatgcggcactcatgattgttacaatattgttgaaaatgttaactagcacttattgatgtaattcccacttaaggaatagtaaagagcagggcctgaatttcaaacccatcctgactgaatcccaaggccgatgcccttggcctctgcctgctctgcttcatagggaggacaggttaagtggtgggttatcacaggggcagggtgggtgggatccatcagaagtggcgagggcctggggttggaagccatgtcccattcctttctgaatccccatttgccagcgcagttcctggcatgcaggaggtactcaagtaatttaattgaaggaatgagggaagattgaagatgagggtccggtcattctcaggtgctcaaactgtctggctttctggaagatggaacctactattataaaaaataattgctgcaatgactttctggcaagttctgatttgaattcagaactccccggacacctttggagtggagcagggaaccgtgggcctggacagaggtgggaagctctcctctggggccaggcaacaacaaaagttgttaatctcggcttgtgcaacctaaagggcacagatgtcagctgagcccaccctgatgtccaggatcgcaacaccccttggagatccctgtgctgtgccatgtgtccaggaaaaggaccaccctgtgctgggtagcagctctcacagcagcagccacccaacacaggctggtcctcttcttgggcacgtattagtcagatcactggatctcagaataggaaggaacctcattgggcccactggtggccatgagaacgggccctgcagacctccaactgtagagagtgttattgactgaggaccccagctgctgtgctctgaaatccacagctgagtctgtgctgaggctgcacttcctgtgactgagtggggcagggatactgaggctggcccgttctgggagacgcgggactcctgtgacagccagctttggctggaggaccctccaagggccttgcagaccacatggtggtctgggatgctgccgcctgacctttcttcctctccccacccctagggtcagactcgcttcatggcgtcactgctctccagtcttccccggcttcctccccgtttttccctcacaggtgtcttggcgtggctctcagaggacgtgctgccctaggcaggtttgcctccaacacgagggtctcagccatcctctaaagggtacacgggagacaatcccaccaccttcctccgtcatagagtccgacaccttatcggtcttccagcccaaggatactcccgcaggtctaacctaatcccctgtgtgcaatggaagtcctgactcccctgaggaagaaagagagccaggcatcagccagggcagggtggggcccaggagaagccgagcacctacctcgtcccccaggcaggtctctatcagcaggccccagaagtctgtaaaggtgaccctgtagccttcctggctgcgctgccggagctcctcctggaatttgcggagctggtctgggaacagggagggtagcttgtcctttaccacatgtctccgagcctcaaagatagcaggctccaagtttttggaggaccagtcagggtcacggtacaaggtagccatggtcctggaaagagacaggcacagctgatagggctgacccggcccctgtctgatgagtcctggacccgggcaggagggaaggtgggcaggccattgagaaccctaacctgccaggaggggaacctggagagtaggggtgaggcagagacctggcagacagtgaggagcaggggaggtgaacattattactcataatcacaagtgctaccagttctcaaatgcccactgtgtgccaggcataacagtggttaagatgaagattctggatccagaactttctggatcaagccaggctctgtcgctcactagctgtgtgatcttgggcaagctacttaatcaccgttcccttcagttttcctgtctgtggaatggggagaattacaataattgtacctgcttcacagagttctggtgaagattacatgagttaaggtgatgtggggtagctagaacagtgcatggcacagaacaaatgctggagcccacatttaaacccaggctcgactgattacaggtcctggctgtttctactctgccatgttaattcctataattctgatgttgactgaggatttatttccctttctcttcttaacttacatgttggttgtcggggggagcaaaacaaagaggtgatcccactagccctgggtctggcctcagtctgcctcttcttggcctggatccagcttttctgcgtcaggacaggaaagggcccttttcattctgcgcctgagaatgacctccctggcagtgcagctagtctgcggctgcacatttaaggaaacaggggcctcctccctcacaggacttgcttttgggaaggtgggaggtggtcaggagacttttcaacaaaaagcaccctgctctccataagcttcacccattcattttatactttaaaaaagcttccagaagccattgcaaatgagtttttaaaagaatacgacttgtgctttccccaggccaggggaccccacccatcccaccccggctgggcctgagttcctcctgctatctgtctatcgcatagtagtccgggaggacgcaggtgcccctcaacctgctggaagcaagttaccttcttaacctactaccgggggcagccatttagcatggaggttaaggatgtgggcccgggactaggttcaaattctactccactgctcattaactgagtgtccctggcaaattactctgtttctccagctgaaaaataatgacaatgcctctctcatagttttttgtgaggaagaaacaagatgagccataggaagcagtgactccagtgcttagcaagaggcaaatgtctccttctgtctcacctgggctggcgcctctgccccccgggggggtgtgtggcacaggagcccttggctttccaaggcccattcacatccatttgctcacacgggggctacccagagctcctccagtatacaaggcacagcaagggacctcagggctcacaggcccaccagtcacagacaggacacggccctgcttgataggccaccctgaaccagggccacgcagggttttgatgggccccacaaaaaatgtttatatgttttttatttttgttttttttaaagacaagtcctccctatgtggcccagcctggtcttgagctcctggcctcaagcaagccttctgcctctgcctcccaaagtgctgggattacagatgtgagccaccatacctggccacataaaaaatattaaaatttatatttcatgctggccacataaaaaatattaaaatttatatttcatgactgttgtataaagacaaatgtattcatattatttattaaaacattttcttcaacctataagtttgttaatgaaatgatcctgattttaaaagaaattaacctatttttgtgggcccctaaaagtacagtgagccgcaggcactgtgccttctgtgggtaagctgacctcaccctggcctccctgtgggggaacccagtgctcagcccctggccctgctcaccagcagagggtgagaaggagggagctcagctgcagggccctgcccgttgcatgtccccagcagtatggggtcatgttcctgggtccataccacagccccagggaaacagtaacaccaggaaaggccagggcatacagtgtctctggcatacttagtagcgggagagcgtcttacacccaccgcatgaggtcagagctactgttatccgcactgtgcagatacacaagccgagcctccaaggagtcaagctgcatgcccaaggccacaccactgcatgtggggcacttcccaggcttcaggagtcactttgtctttgggtggcggggaggagcttcacctgagaccccaggccagcctgttcgtggcttgccctgggctccacagacagtggctcatgtctccttaccaggtggcccctgatagaccggtgatgtagctggcacagtccaggaggttcagcttctgcagccccagcaggtggccatacatggaggtcatggatcttgttccacccccagtggccatgatggctatcagcggcacctggggttacacagaggcaggcggttggggaaggctccagaagcaaagcttgggagaagacttagaatgacggcaactttgaaagaacaatggaggaggcagagctggctacagagggcagggagtgcggcgttgagccacctgacacctgcctttccacagagcagtgggtctagaaatagacctcagctccacacccagaagttggtgtcagtgaaggactctgaagcctaacacaggcttggtaaatcacagaaagctgtggctagcagagttcttagcactgttagtctagccctcggttaacaggtgataaaactggggtccgagggtggtgggcagcttgttcaagaaccctactaatgtgcgatccctcaatgggacaaaccaacatcttctgtagctggatctgagggaaggcaccaggcctggcacatggtgcctgctcagcaggtactgtactggcaaggccaagagtcaatggactggtgatgtgggaaggagcagggttgccagctctgggtcagcagaggtttaagaggcccctggaatgtttccctaaagatagggccaggtacaatggctcacacttgtaatcccagcactttggggggccgaggtgggcagattgcttaagcccaggagttcaagaccagcctgggcaacatgtagaaaccccatctctacaaaaaaatacaaaaattagccaggcattgtggctcattcctggagtcccagctacttgggaggctgaagtaagaggattgcttgagcctgggaggtggaggctgcagtgagctgtgatggtgccactgcactccagcctgggtgacagagcaagaccctgtctcaagaaaaaaaaaaaaaaaaaaaaaaaaaaaaaggagggaggaaggggctctttgtcaagactcattctgtctgttttcctttgagtgggggctgtaagaaccttccattggctaaagcgctattacaagtcctcctcgggcacccgccaggtctctgtcctcacctagggtcagcctcagaaagcaggcgcttggagggcttgcctgctgcccaggcgagtgtgggccttggtccacacaagggaggcaacagagggctgtgacagaggcccaccgtctgctcccgtgggaagaaggggcggtctggccctaggagtgcaagttgcttctctccagcttcctagcgctgttatttctgggagtgtgtttacctgtgcggatttgagaggagagacaattgaggaaagaaggacctaaggccttttgggtggaggtgtggggtgcagaaggtggtacagcttaaaatgttttcctggctggggtgaggagggcattttatccctgagtaaggcccctttagccacagcaggaactcttagtgcttgggaggaggcgctggggctctgtcctttctgtctccattttgctctccccttctcttgtgaatataaaacagaatcacttccagcacagctctcaccagggcgcctgtacctcagcagtaaaagcatccatggaggtggcgcctggggtagggcagggcctgggttggctgggagggcatggtgctggaaggaccagctgggcccaggctggccacatccctgattacccacctcgtcctcctgcaggtcttcctccagctgcagcacctgcttcagggccttggccaccacgaccttccgcttctgcagaaactccagctctgctgggcacaggctgaagcccagccgcacgtccagtgtctcagggctggagggagagaggaccctgtattgggcctgcagcctctacctccctggagtagacacagcttcagggtccattggacctaggctcaaagcctacttctgccagcgaccacttctgtgaccttgggtctccactttcccatctgtaaagtggggcgaatcgtgctgaactctcagcactgtcttcagcacttaaagagataacaaatgcaaagcccccaaagccttagctggcacaatgcgagctggtactcaacaaaagataactgttggcactgtgttagggacgctttgagtcctctgtctcctcggccagatctggaaagtccagaaagtcttcccccaggtggcttctctagcccagggccaggcatgggtgacaaaaggcgctgagatcattttgccaaatccctctgaacaaggccccacggtatggactcttctgtgctaggtaaacaaactccctgttcctatggagctcacgttcttcaatgagctcttcctgctcctagaataacaattattctgtgtgtgtgtgcaattgacaaaaaccatcccattcctgatctcattgtgtcacctcatagtctgcaggcaggtggggcaggcacctctgtgacatgcacaatgcttgtcctcttttttttttttaatcacatccctgccccaaacaagtccaggctcctggcctggcatccaagaccctgcctgatctttccaagctcacctcaaactacccgcgaaacttctgggtcaggtcccagagctcccagaagcagtcctgtttccgggtcttggcacaggcccctgccttcaccagaagtgtcttccctttgcccacctccagcctgtgcatcctctgaggcccagctccccagtgactccagatgaatgtaccttgaccatttccaactgagccttggctcactgacaaagccacatctccttgaaggctgggcctaggagatttccatcatgtctcctctttgtccagcacagggctgcagacatggctgttagaaaataattctttctttggcctcaacagggaatgaataataataatacaacaacaataataacaataacattagctgacgtttgctgagcatcccacttgccagatggattactgagtacttcgcacgtgctgtctagctggatcctcagagcaacccagtgatgcacaggatccttgttattctcccaatgtacagatgaggaaaacagagactcagtaagggcaaagagcttttccaagggcaaatagctaatcaaactgtcaatagaaatcatggccacttgatttctgacaatcaagatttctgaaaacgatgttgttttcagcagatggtgctgagacatctggatatccacatgccaaagaacgaggttgagcccctcttttacaccatgtagattgattacctaaaaattgatcatagacctaaatgtgagagctaaaactaaacaagtcttagaaaaaaacatgggaatatattttcaggactttggtcgggcgcggtggcgcacgcttgtaatcccagcactttgggaagccgaggagggtggatcacttgaggtcaggagttcgagaccagctggccaatacggtgaaaccccgtctctactgaaaatacaaaaattagccaggtgtagaggtgtgcatctgtaatcccagctactggggaggctgaggcaggagaatcgcttaacccaggagacagaggttgcagtgagctgagatcacaccactgcactccagcctgggcgacagtgagactccatttcaaaataaaataaaataaaataaaataaaataaaaatttcaggacattggattaggcaatgatttctggtttcttagatatgacaccaaaagcacaagtgacaagataaaaaaacaaatttcctcaaaagtaaagtcctttgtgcttcaaaggacaccaacaagaatgtgaaaagatacgccatagaataagaggaaatatttgcaaatcatatatctgacaagggatttgtatctggcatatgtaaagcactcttacaacttaacaataaaaaaacacaaataacccacataaaaagtgggcaaaggatctaatagaaatgtctccaaagaagatgatatgccagccagcccatggaaagatgttcaacatcattagccataggggaaatgcaaatcaaaaccacagtgagataccactgcacacccactgctatgaataagtgagaggcacggacagaatgcgggtactataccagggtgtagacttcatgtgtaattcataactctcaccctggggagggaaagatgaaaagcttgtcagaggtgacaattcagagccaagtgatcccagatccacactgtccacccagaccccactcagcacacacgtgcacacacaggcgctccatccctgcctctctcttctggacacaatctccccaccatcttcaactcagcctccatacactctttggaccacactgtagctcatcagtctcctgccccacaagactcctccatcctgcctgagagagaccctcacgagtcacattctctcttgtacctccccaggctctccccacctccctaccacaggagctccaggggaagtaagtcaggggcccttcccagactcaggcactcaccacaggcagggtcatcacctgaccatcggaaaggcagtcgaggggctggctgatggggcccttcttgcgagagcggcagcaaagctggagggatgggtgggttctgtgagaggggctggggagctcctctggcaccccccacctgtcccagtcccccacacctcccccagtgtcagccgccttgtaccccacagctccagtgactcttgggcacttccacgtgcacctgggactggaagtacttggggtagtggaagcaggcagcggtttggaagcaggcagaggttgggcagcagggttccaagcagggccggacacgctgggtgttctcaaaggattcgttcaccatcaccaggaggtccttcactgggagagaggacaagagggtgagaccctgggagcctctcactacccacctgcaacttggtccagcaaaaaacctatttggaggtatccaggaggagtttagaatcacctggggcaccagttcaaattccccagagattctcaatctatagggtagggcagggcccaggaacctgcattttaatgaggtttatgaggatgcagacaaacatagtccccagaaaaccctttgagatgctgagaaggtcctcaggaccagtccttggctcagctttgccagaagatgccccaaagtaacctgcccactgtagaggaggcagaccctccgcacactgtcgcttttgatgtagacgcctcttctgtcctccctccctccctcatgtctggtagccttgcatgggcaacatggggtggggtggggagtagggtaggggtatggtattcatggatctcttaggtctctgccagctataaagtgctaggaccctctgtgagctgtggtctgcctagaggaaggggcatagttagaggggtcctgggcttcgggtgctgaccacctcactgacctaggcaatctgaggtcctggcatggcacagcacagacaagcgtggatagagggagcagcactgggaccccagacctgagatactccaaggttatgtgggtgcttgggcgaacacgccctttacagagcaggatgggaggccaggggctcaggacccctgggggtgagatgattctgaggggtttcagccgagcttttggtccccctgagcccagggaagccctggactaggtggagtctgatgctgatgggatttggaagcagctcccccttgtcccccagtaggcagaaaaggcaaaacagctcacttttctccctcttcctccgcctcctggattgtgcatgaacctccaggcaggagacttgtcgagactgtaaaaaacaaaggagggtcacagagtgtctgagcaccagccacctccttgctcttccaggctgaagggagatgagggaccagaggatacattcagcattggtctgactgggctgatgctggggaatgcagaatgtgttgaccacattttctgaacccaatcaaggcatgccatctcactcagagataggatacttgaccacgaagctgtcccaggaggtctaggacccacggtcacagtttactaggggtcaggtcctcagctgcaggtcgggaatctgacctgagggaatgttcagctctgggctttcaaagtgagggcttccgacaaaatagccttgtcaagatgctgaggcagatcatactcctttgccacacattcccaaagactcttctttttgagggagaggtctccttgaaccctgaggcactggatgcatttaattaaaatagctgtaccaacagccgaaatatgaatttttgtttttggcacagggtctcactctgtcacccaggctggagtgcagtgtcataatcacagctcactgcagccttgacctcctgggctcaagcgatcctcccacctcagcctcctgagtagctgggactacagacacatgctaccatgcctggctaatttttgtatttttttgtagggatggagtttcactatgttgcccagacttgttttgaactcccgggctcaagtgatcccccaaccttggcctcccaaagtgctgggattataggcatgagccaccatgactggctatgaaacaatttttaatacagaaattgtgcttgtaggccaggcacagtagctcacacctgtaatcccagtactttgggaggctgaggctggcagatcgcttgagctcaggagtttgaaaccagcctgggcaacatgttgaaaccccgtctctacaaaatacaaaataatagctgggggtggtggcgtgcttgagcacgggaggcagaggttgcagtgatccgagatcgcagcactgcactccagcctgggcgacagagtgagaccttgtctcaaaaaaaaaaaaaaaaaaaaaaaggtaaactgtgcttgtagaattactggggttgtggggtacaggaccaagactgagtctgagaggaggctgcacttagtgggttgttttattggggaggctcttaaggggaagggtcacttttgggatatgaagtgctcggccagggtgatgtcccagctacctcctccctctgtacagaagccccagctcgtgccccagtgctgcctgtgccccatttggctggcctcgtttagtctaactcctgcagaggtcaggataggacagagaccaagctgggcccactgttttctcccttggtcctgttcccctgagagcagcagccagccgtggcctctggagctacaggaacccaggaagataattaccaccagcacgccattggtgacgagggtctcaggtggagagggactgaaaaacaaaaggagaactcctggtcaattctagcattcttgactggtttcttctaatggcgacaaagggaataaatagggtcaataacaaaatatcagagccttctttgttctcataaaaaatactagcttcggaaaccttagccttataggttgtcagggaggaaactggcctacatttgaaacagaatgtccaggaaaaaaatagatttataggttagaagagtaggagagttctatttttttgaaaggataactgttttttatgtctaaccagatgcaaatgcatggggttagaagaataaataggttgtaagaaatggctgcaacctgccagctagagcagacataaacagttttggtagtgaaaatgatccattctccattctgtgctttatctaacttatgcatttaacagtctgacccagctgagagggtgaatgttaaatgcccttgtgttataaagttgagaacataagcctccaaggtttcaattagcctggcagagtccacagcatcccttgtcaaaattaagcccaaggtgactgtgtctccagatcaactttattgttgttgttgagaaggagtctcgctctgtcgcccaggctggagtgcaatggcacggtctgggctcactgcaacctccacctcctgggttcaagtgattctcctgcctcagcctcctgagtagctgggatgacaggtgcatgctgccatgcccaactaattttttgtattttagtagagacggggtttcaccagatcaactcttattaccaagcatgacatgtttcattttgcaagccactttctaattcagcctaggagttttccccgccctctaaaaattctgtcaaatcaagaattggaggggagagcttcgattttcttcaatgttaagtaaataacgttgattttaatttgccaatcagctgttgatgggaagtaagttccctcacatagtttgaagatcccctaggcagaggattctccaagtggcagttgacgagccctcttgtcctgtctcccacctgtcatcctccttctgttcccgggctcatcacaagcatagggggctcagccctgccaggtgaagaagagggaggagtgaggaacaagctgcccagttacagggcactctgcccggcctgaggcgggggttgcctttctttctttctttcttcctttccttcctttccttgctttccttccttcctttccttcctaccttccctctttgttccctccttccagacctccagctctctgagtcctcagcacagtcatgtctccaggatcctggatcgttttcctaattgaaaatgatttgggctgggcgcggtggctcatgcctgtaatcccagcactttgggaggccgaggcaggtggatcacctgaggtcaggagtttgagaccaacatgatgaaaccccatctctactaaaaatacaagaattagcctagcatggtggtgtgttcctgtaatcacagttactcgggaggctgagggaggagaatcgcttgaatccaggaggtggaggttgcagtgagctgagatcgcaccactgtactctagcctggatgacagagtgagacgaaagaaagaaagaaaggaaagaaaaggaaagaaaggaaagaaagggaaagaaagagagagggagagagggagaaagggagaaaaagggaggaagggagggagggagggaggaaagaaggaaggaaggcaggcaggcaagaaagaagattggaaagaaccctgcaaggtgggcctgagcctcccattgacgtggttccagagttggctgcagagttggctgcttgcggccagggttggggtgtttgttctaacagttctggtcaaggaagagacccctgggctctgacctctttctcagctgggcctcaacaaggcccccatcgccatggtggcaggaactcttcccagaagccacccttgggaatgtagggggcctgaggcaggctatttggccagagtactagatctttaaagcaatgctgagggcaggagaactgggtaagtgcagtggggcccaggctcctacactatggagaagctcctgggtgattctgatgcacagtgaagagtcagggttagtgccaggagtgagactggaagagggtgaggcagcaaaaaggccgacctgcctctgaaatgctcgttcccagaagctacttgatggccaggaccttggtgggccccggggcctgggcctactcacctctcctccagcaggaactccacctccagctcttccatgccctggtaggggagggagggaaggcagctgtgagtggcgtctgcacatctctgctgaccagaaccctttgccaccctgggagccgctgtggacctgcctccgtccttcccccacagctgcctgctgccatggagtgtgcttgtggtctcctctgccaatctctgtccccaagtctttgacatcaggagcatcactgacagcccaggggaggtcagggtgtggagctgacccccagccccagcatgtacattcctctgcccgagagcatctcctttctgtcacttccctggcttcccaccgctctcctgccttcccaagggactcagtgcctgtggcaagggagcgctgagatacgccttcagaaagcccattccttccttcactgagtccctcacacctcttgctgtgtactggaggcaagccagggcctcactgggccttactttccccaccagaatgtaagctaggtgagggcagggatgctagttcccaaggggacccagtgcctagaacggtgccggcccctcacaggcactcaaatgctggcagaatgattgaattgacagcatcctgggggctccagctctgactgtctctgatctgcagattcgcccacctttaccctcatctgtcctctgttcctggggccatcccagcaatgggactctgagggaagaaaaggagggaagggaaccaagacttactacctctccattgtgttctgtgaacactgctagttgcctgaattatggtttctcatttaagtcccacaacaaccttgtgtggtaggtattatgatcaccattttgtagatgaggaaacagaaacttagggagttatttttacgacatcacatagtgagtgacagtgctgggatttaaaccagcagcaccatcttttctcaacttgactgtgtacacagagaagaccctggggaatggctttgtgggaatcagcaacagctatgaggttatcatgaagccggagtctgagggcctgtaccctgcacccacctgcgggttgagtggaaacttcacgtgggttttctttcggaaacagagcttggtgaggtcatagagaactgtcaggagatggtcatctggtgtcactgtgtcttcatcacagacactcaactctagcacgttctaggggagaaggaaggatgccagtctggttaccacggttgcattgaccccttcccagaacaaggggcttgacctctgtcctagcaaggaggtaggtctgggggatgggagacagcccagaagtccctgctcagatgtgacagacatttgtagggaaacgaattaaggaaggcaagtgtctattccctcctttccaactccctgaagccttcttggccttctgttctcactttcctgctagagaattttgcctcttttacaagcttggtagagacctgtgaagtatggaaggatttagtttcacctgaggggaaggatggatgggaaagagcaagcaagacccctgccaggatatagaatgtggtcagcactgggcccctgggcactgaagacagcccctttggtgctagaaaatccagattagggaatcgaacatctaacactccagggagtgatgtggcaaagcttgtaggggttctgataattggtggggtatatgaactctatcctttgactcatcagcccctagtaagttctcatggatggtcccaaagcagctaccttgtcatctggctgaactctgaggtcagtgttctcaggtgacatggactaatctctgaggcctcttgttccaaggatcctgggggatgtgggttgaggctgcctcttaaatacatctagtggacataaggtggttctggaggttcccaacgggatgtgattgttgaccttgtaattactagaaacacaggtatgtcccagaaccaacccagcagctccacaatccaaaggaagctcaaattctgatttcaagatggcagactgaacccacatcaaaattctcctcccttaccaaactcacatgtatgatagaaaaggtattttaaaaataataagtataaagcccttcttgaaaagatacgtcacgtaacaaaaataaataagtatccctaaaacatggaggcagtaaggtggagctgtcaagcctcaagcacctccagactggggctgatgccactatgatgaggccaaatttgttgtaagggatctctgctgaggctgtcacaactcaggatgctcaaaggataattatcccatgggagatgtgaactcaacttagagtcatcatatatctgaagaagaccaatcccatggaacaactcaacaaataaaatacacacccaaagaaatggaaataataaagcaatatgaaaagaatttaagagggagagaaccctctggctggaattagactggcctcagacctagtgaatagaatggttctttcactctgtgtattcccctgcttggagaaggctctggaaacacaatctgttttggattaagagacacctagtttcagcaacaattaggacaagagagaccaggagaaaaagctagaaagagaaatagactcagagaggggcaaacatgagacaggcagaaggaagtagtgggtgtgagtgggaagacaggtttgtaggacaagaagtaggcagaaaggaaaacaaagaggcataagaacacagaggcaaagagaaggacaagtgggcaagaggggagtaaaatgcagacagggaagacaggtgcagtcctccatgtctcaccttcactcggctctggatctggaagttgaagctttcattccactctggatttgggcagttggagatggtccttgtcctcagcttcttctgagaggcggtgggcagccagaggctcacaaaacagtctgtctggctcactgtccaagaaagataagtggaaccaatccaggttcagagagaacatgtggagtcaaaagggaacttcaggcaagcctcttccagagccaggccccatctcagctccagttcctctcctcattcatgggtctaactttccagagactcagatccccaagaagtcacagattgcaggctgtgggtctcgcagagggcgacccaatcccactggccattctcatagacacagatggcctccggctcttattagaagcacccttgtccctgagcaaacacctgctggtttgggacaaggtatggtcacacagttttccctctgccaaggtaagatctggaagaccagtccccaagggtccggattacttcttgtcttagcccaggggaccaggaaaaccaaagtagggccaagcactccctctgggctgaggagaagtgaggatgagaaggaacactctgctgtgagtcggccaagaggaagggccccagtgggcaaggacttgagtgaaactagctattcagcaagatctaggagcaggaacccccatctccatatggcttaatgcctccactgcatccagccaggctcttcttacctatcctgatctgcagcatcaggttatggcccaagaaaccctcccctctgtggccacatacttctttttcattctaaatgaacaacccaagtgtgatgttgctggatatgctctggagaagggacagaggctttgaccccaacaagccctcccaaaatgacagaaggtctcctaagtcttccacctggagcaacagaagggatagggtgaaaatagtagcccagactggctccctgctctagtctacctgggaggagggaggcagaggggccatgactgcccctgtcactctcctggcagttggtgagggtgaggcccagggtacacaccagatacataggaaatggtgaaagccagcagtttccagtgtcagagagtcctctcgatggtaaagctggcaggaggatgggagttctacactggtaggactgattcaaactagtttttaattattaatagtcactgatgagagtggagccagggctttcttcgccctgcgttgtcaccacactgaaaggtttatcagaatcaacagccctgatctaaatcacaggtgttcctagcttctgatttcatccctgaagtctggttaatctttgaggcctcatcatccagtgaattggaattcacagccctcctcctattgaagaaaggtgagatgacactctcttttagatgtcatgataatcacttaatccagacaaaaagaatgattgaaacccaacagaatcaaaagaaaatgatgacctcatcaacctactcttcccttctatgctcaacctgctcttccttatcatcactcaggtgtccaggccagaaatcagtgtcatccttgactctcacattcagttgatttaaccctttgtctctctcaggacccccaacttctcatctgccctgccactgccctggtgtagaccaccataatctctgaggccacttcccagataggcttcccatctcctgtcttgccccactctaatcttttctccaaagagaagccacaaggagctttttagatatgaccatgccattccccagttcgagatcctccaggggctcccttctgccctcaggaaggagtcccagccactcaaagtggctgaccctgctcacttccccagcctcagtctcatctctccaccctccctaataccccacccctgccctgtgtgtgcgagcatgtgtatgtgtgcacacatgtacattcacacacatttacacacatacgcattcactcaaacttacacacacgcactcaccgtttagactccagccaaacacagtcacttgtattcaaaactgcctttgcacatgtagctccctctgcccagaacactcttccactttcacccacccttctccttgctagccccttgggacttcagtaggaacctcctctggaagctttccctgagcacccaagtctggaccaggtaccccagagcccagagtcctctgttcctctcctggggagcacccctatgctgctctgcaacaacaggtggactcatctgtctccatcacactgtggccacaggatacaggtacagatacatcactgcagatacaggtcagaggtcagtgtgtctcattgctctgctgatagggagactcaccaggaacctgctcagccctcttgaacccttcccttggcttttccagaacactggcccccccaccccgggcctggaccacacccttcaggtctgtctccggtacgctgggagcctgcaggcagggtgccagctctatacctactggttctgtaatgcacttggcgcgcatgatttgatggaccctgtaagagccccttccctctaaaattgttttcctgtcattcgtccatgcctaaaattctccgataaagcccattaaataaaaactcagtatttttggcctaaggcttaaatgtctagttaagataaagaaatattcctggcagagacaagattgatcagacacccacattccaagcattagtttttcagttcttttgcagagagctgcttcccctgtccacccccagcaatgaatggttaggcaacggtgacctggttctgagaatttcatggactatggggatttcctaggcacagataagttctaatccttgttcctagtggagtgacagagggcttggtcatctgaatgacatgtctcctttcctggaatgtgggtggcagagatgactcaatcatctctatagatgttcagaactttgtctctctaatacctctggagacacctgtctgatatcccttggggtgctggtttcagttttaatttctcaagagaaacaaaaactcctgacaactgggaggtttctaggcctgattgtctctcagtcctggcccaaggctctttcagttatcgaggagtcagccctgaatcttgagtattcactgccatttggcctcttggaaactttaggagactcaggcacaagttacaagactaaatggaagtgctgtttattttggattcaaactagaaggaaaaaatttgggacaagggtaacccaggacctaaaagacatcgggatagtcttaatctaacccaggcaaggtagcaacacagcccagcctgcagcaactgtggaatccagaccagacatgactggggttggcaccccgagatgccacatgtgccttccgccttgttcttcggggaaatgaggaaaacgtaagcaacaggggggtttccaaagagggccaggtatcgcccaaaggcagcctgtctgcccaaggggcatgtagggaagggaggaggcttgtagagccagactacagcctgtttctctagctgcctgctcttcctcacaccccgtcacctgctgagtgacaggtgtggcaggaagaagacagaagaaaggaccctggacagtgggaagtctgagcatgcaggtgcaggcatgcatgggggcatgcagccaggtgactggagaggctgggacagacacacctcaaaaggagttggagggctgggcatagtggttcacgcctgtaatcccagcattttgggagactgagacagaggatcacttgagcccagaagttcgaaaccagcttgggcaacatggtgaaaccctgtctccacaaataattttttttttttaaagttagccaggtgtggtggcccatgcctgtagtcccagctacttggcaggctgagatgggaggatcacctgagcccaggaggtcgaggctgcagtgagatgagattgagccactgcactccagcctgggcaacagagtgagactctgtctcaaaataaaataaaaataaaaataaaaataaaaagcagaaggggttggaggaaggtaagcactgctgtggatatgtgggagctgggttgtcccaaggatgagggtgaactctgcccaagagtgggaaagtgtctgagtgaccaccgtggcatggacaagaaaggcaagagaggtggccacgtcctggatccagaggacactccctggatcctcaaatcattcaccgataggctgggaaagaccccaagaagcttgaggaaaagtccctggccctttggttggccacttggcagacacagacccaaactggaggctactggagccactcctgctggcgcaggctctggacacattgccctccagaggctctgtctctggaatcctgcttggtccctttgctgtctctggggctcagggccctcccacacttatccattcacactcagccctgcattggagtgacagcttcctacaagttcccagactctccgcacctgcactctagcacaagctgcatacaaggcctcaggaagtcatgcaatctcttcctcaagaccccaggtaccccaacactttgaaggcatccaatccctcctctgcctcacttcctggttctccatacctggcttgtctcctctcttgccacactctccacacctgggaccagaccctacttccctcttaggcaatcattaacctcttgttgcaaaatgggcctccagggcctctcctcaagttgctgggagcatcgggtagtgtgtggatgtctggctacaggtcagccaggcaggtgctcagggggtgtggctcccctccctcaggacagcctctccccaagatcgggctcccaaggcctctggatactcaggtcctgcccctctcagaccccaggctctctgtgcagcctttcttggccactcccagctctcattgttctcctctgcctctaaactccctggtgacaagatgggaacgttgttattctataactgctttggacatagatagctcctcttgttaaaatgtacactcaatctcagggctctgtgtcttctctgcccctctcaggccctccctagcctttcgggatccctgtggcgcttgagtcattcctgtgtggttaccggtgagcagggatgctccccacctgtggggcctggatatacagctttttcccccttgggggccaacttcccctctggatggggccaggggtgggcagtgtgggaggggctttcagttctcctgatctcttaaaatgccacccaaagacaggggtggggaggattctgcccactgagatgcctccattggcccccgtggcctggaaatgcagcaggctctgggatgaggggggaggttagggctgccaggaaacagcactgcacaaacagtgctgctaagtcaagccacatccatgggctgaactgtagaactgggtgctgtggactctggcatggtccccagagcccagtttcagatctttgtcttgagaaggggctctgggagtcacctggcagctggctccacgatgcctaagtgcctctccttccacttcaccccaacaggccctaaccgaaaggaggagcaaggagtgctccgtgtgggcaaagcgggtgctcttggaaatcgattccaggaagagagagtggggaggagacagagggcgaacagagctcttgggtgcaggcacagactgcggggcaggtagcgccgagggaacagcatgaacaaggggcctggaagagtgacagaaaccccaaagtctgaactacaacttgagtatagaacacacattcgtgcacatacatgcacacacatacacgtatacaccatgcacgtgcacacgtgcgcgcgcacacacacacacggatccacctgaccatttctccagccagggcctcttccatccagatccggtaagcagagaaggagagaagtgaggtggatactcacgcatatcagcctgccggacatttttcatccggatgaccctcactgtcaacaggtggcatggagacagcccctcctgtggaaggagaggacagaggactcagtcttcaagcattactccaaggccattgccccgggggagactttcccgctatgcctcctcaggccggcccagttgcattacaacaacccctaggctggtttttttttttttttttttttttttttttacagagtttcactcttgttgcccaggctagagtgccatggcgcgatctcggctcactgcaacctctgcctcccaggttctagtgattctcctgcctcagcctcccatgtagctggggttacaggtgtctgccacatacccagctaaatttttgtagttttagttgagacagggtttcaccacgttgtccaggctggtcttgaactccttatgtcaggtgatccacccacctcggcctcccaaagtgctgggattacaggcatgagccaccacgcctggctccccatgctgttttgtcattgtttgctggggtttctgtctgctcttcagcctggaaggtcctggaagctccagagagcctgggaccctgactggtttttcatctttgtacctccagtacctatagcatgctcatatctagaaggtgctaatacatgttcattaagtgagtgaatgaatgttccagccccatgcacagaatgaacgcccatggcaagggagtcctgaggtgttctccctctcctttcttcactgaatagctgcttattggcactctcctcctactgtcccacatgcagatatttgctcttgcccaggcaagatggcagcctgcttgggaggcaggcacagtgtggctgcgggaaggggggtgacagacactgatcacgcacggtgacatctactcactgggagaccatgtgccaggggctcacccccactggtacttacttagctccagcccaggcctttgcatctcccttgccctttgggcctcttccccagggtatctcccccaggtccttctggtcactctattttcccttcccaggaaacagtctgcctctctccactccactgtttctcgcaagaggtccttgtggagtcttggctggtctgcgatgacctctctttcctgatggcaaaagctcaagtagtccttggtttgatgactggctcctgtcagatgcctctgcgggtcatgataaccccaggggaccagagccctgaggtgtcccccttccctagcaccttgtcctaacaactggggtgtgggaacactcccagccctgctcacgcggtgctgatggctcctccttccgtcctgcccctcttctagttctgatcacctcctgggggctctgccatcatctcaagcccaggtcctcaaggaacacccagagccctccctgggctgcagtgtctggggcagtggctgtggttccttaaggccccacgtccctcccgagctgcccctgcactctgagtctcgcagcagccactactctactttatcccttttggacccattacttcattactttctgcctcccagaggccctgaaaccccctcttccagccgcaccagcttctctggaccctacagcaacagagtgtcgccggatcatccttcctgcctaccgagggaccgcagcgctctcccagtgcccctctgcctgttgcccttggccccaggcgttaagcctgtgggagccgctcccgtttcacccctctcctggccagcgtctcttccatgggctgttttcagagctcagggtctgtgtgctcgctggtagggctccctgcctctgttgctctgagagtgccagccctctgattgttcctctgaatgaatgaaccatcttctagagtattatttttgagcacctactgtgtgccaggccctatgctagatgctggggggccaggggtgaatactaggcagagacagaggttaaaggcaacagcggccagtggctttgatggggagagcaggtcaagctggctacaggctgttgctttccaggcttggggcctctggctggctccagaagcttccccgccatcagtcatgctcctggactctggaaacctcttctggtccctaggggcccaaggctgcagaggtgaggcgcgtttctactctgagccggcacacccgggaaggggcagcctcgcacgggttctcttcaggtgtcctggttctgttcttggttcatgcctttcctgttggaactcatgacttgaagccccttcgctgagagttttacccacgcttagaagagtttttgttgtcgtccattcccagcctgagctcacggtaaatgcctaccaaccgaatgtctgtatttatagaagcgtctgaaccggcaccctcgacatgcgaccctgaatgttctactccgtgttgccagaatcactttatacctttttaagaggattcaattcttctctctttaaatactattgggattgggggcaggagaaacaagatacgaagaaaaaaaaagtttctataatcccaccactcagagaccatctttttatctttacttttttttttttttttttttttgagacagggtctcactctgttgccttggctagggaatcttttgatgctggtcctttcagactttcctggggcttaattcttttttctttggagacggagcctcactctgtcatataggctggaatgcagtggcgggatatcttggctcactgcaacctctgcctcccaggttcaagcaattctccctcctcagtctcctgagtagctggactacaggtgctcacgaccacgcccggctaatttttgtatttttagtagagacgcagtttcaccgtgttggccaggctggtctcaaactcctggtctcaggtgattctgcctacctcagcctcccaaagtgctgggtttataggtttgagccactgtgcctggcccctggggcttaattctgatcagcaacagaatgctgattctgggaaggtcacgttatttagccccttttaaggtctcttctcctctcctgaacagctgccttaaaaccaggacaaaagtcaaactcacagccaattataggtctggagatttattttgtgagatcaaccctgaaatattgaacatctcatggtcaataacttgctctaacagcattctgttgggagccggagacttgggccaaaagccatgcacactgcttctcttctgatgctggagacacagctgtggcctctggccagacctccaaggtgcactcctcctttctcactctgcccgagtgcagcatgcaccctgggctggcctggtgaggaggcagggtcaactttcaccaggcaagcagttttggcaaaacctgtacccaccggcccactttctcagagggcaactagagtccaagctgtggaggcttcagcccaggcaggagtccgtcctgagggatattccacagtgtttcagggctctgaacccaggtccggtggtcctctcggcctcacaatccttctcctgcctccaggagggggtgcctgtggcccagcctgcctccttcaatatctactctggcagggaaggcgcagccacactctcccttgggacctcactccaggtgtcctgccttccaggacaagttcactcccatcatctaacctcagtgccttccaatgcaggtgaccatttcttcccgctctaactcagcaacaataacagctagcatctgctgcgtgccagccatgcgcaggtgccatgtacaggttctctgtatattatcttgcttaatccttacaaccgccccacgaagcagttattattagcttcgtctttatagatggagagtcagaggctaagtcctttgacacagggctcacagctagaatcagagacatccaatgctacttcccaagcctgtgtttctcccactgagaatctcagtttacttggcaaacaggaagacaaatgttgcttgccttcatctcctcttccttgcttttcttctctttaaaacagtttttctgacagattcttcttttcactcagcgctcccccaaagccaaaaaataaccaccaaactctgacaattcttctatggcctgcactcttactggctgtttctaccaacacattctaggatatccctctctttttaaacatctagagcacatcagagccataagggtctttggagaagttcccattttccagtagccacagattgctccacttgagccttagatcacaccctccagctctcgaattttcaggagagacccagttttcaggagacaaccacattttgccagcacagaattgggactgggaagggggtttgagagacatcccagccggatcatgctgggaggaaggtggcaggaatatgggacttagctctggggaccagatgcattccaggaaccaggtctatgagaaatggccttcttgggttgcaatgaatgtacctattttgcttctgatataatctgtttgatcagtgttgctagagatgagcaaaaattcatggcctggaggtaattaatctacagtggaaagatgcaatcgagcaaagcaccgtgtctctgatgtgcgtgtgggaaccagaaaccagggaggctgtggaacccaagtttacagggttgcttatggtgtggtgagggccaaagctttaaggactcagataagctcatccctagaacaggatgccctggctgggattgggtatcagggtgaagagtcaaactatttaagaacagacatgatcaggcaccatgccagctgggctgcagccctggagtagggacaggcattcatccttcatgagggcattgggagggccctggggtaaggaccagggagcacttgaagacttggagctcaaggcaggaactgtttggcaaacagtacagaggtatatttagccactttgccaatcagtacagctgggccagggaggacaggctggacagcagttttctgggaagccaggggagagagagggccccactgctcaggctgccgacacaccgtcccagccccctccccagcctggattctggggttgatcttggcaggactccactgccccctggggacctactggggactgggggaccttgccagctcatgtggaaaagaggcagccccttgaatctcaggattggctatgatgcaatccaatgctgccccttcccactcctacttttatagatatgacttttggcaggggtgagggtggggaacaaaatgtatgactctgctctggcaggcccagctgggctgtgctctagctgctgtgcatatgctcttatctaaccttccaaccaccgccaaggaaggcatcattatccctgctttacagaggggaaggccgcgtttagagagattacatctcaaacaggcttacactgcccaggagtggcagagccaggacttgggtgcaggtcttcagggcgcatgcactccatccacctggctctcactatgaatgtacagcaccagctagcagcttgctccaggccatgtgctggactagtcagtagcagagacaggaggaaaagcctcagcctcctcattggagctctccctataccccaagaatctagccgttaccacaaatcagtcaaaagaatacttaattaccaaagggctcccagggtcaggctcctgggtgggagtggggtctggggaagggtctgacaaccacatttcagaggtggtggatccgatgcccatcgctgggccagacataccctcagcaaaccatcccatgaagtctggggagcctggagagaggggaagatggcacctggggagcctgcaggaactccctccccagggcttctcaggtcaggccaggcaggtgatgccacctcctcctccctagagagctgggtgtacccttcagttccatgcaacacctgtgtcagagcttggactagccaggtgctgtcttccagaacatgtgggccctcctttaaggagaccattgggaggggacatgatgggaccctaatacatgtcccagccactctgagcaacatcccagactaagagtcacctgggaggagctaccatggctgttttcctttttatcaccaggctagttgagtggtcagggcaagaaatcccggcaccaacatggaccctccaggcctgacaggggcagatgcagctcatggagaggctcctgaagccacatttggggtcccgggctcttaactgcttcactgccccctttgaggtaaactctgtcacctctgtggaagacctctcctggcccaagctcttggaggctcaaaaagattggcaggaacaataggtggccagacgcccttccagccacccaagtgctgtggggaaaccagggcacaccccaggaggcagtgtctacctggctgggcagcaggggcattggccaccacccaccacggagctccctgacttgggctcctaggagactgaacagggtcttcatctcccccaccaaggggcaaagtactttcagggcatcacccatgtcattcaatgatttaacttgagccggggaggtggccctgggaaaggtaatgaggaagaagtgctgccttcgaggaaccaactaatgattcttcccaaggtgagcctacagcagattgaagcattgaggtcatctccctattgcctagatggggaaactgaggcagagttggtctagagccctggcaacctgatccatgaacccagaggtctccctgtgaggctgtgaggagttggatggacccatgagccttgactgtaaacccaggtgggcagctttgtggctgatggcaacagattgacaatgccaccaattctcaccatacactacaccatactcttgcacagcatagaagcttaggatgtttgcagggttaaatcctgcttgccattagggcaggccaaatgtggatccccctggcatactctctatcttgggtgctagcctggccccaggatggccccacgccacttcatgatgccttgaaaatcttgagggtactctcagcagggccacccaagcaggagccctggccccaactgggataaaccacctcccccaggttttaagatgaggctgcctgagcccaggtccttgggatgtccaatgcctaccagccctccctgaggcccgtctcctgctctcagctccctgcccctgcccctcacttcctggccatgcctccctggccctcagcctctggccccagccactgagcacccctccctcaccttcaaggcacaggtggccgagggcctgctgtcttctgcttggcatgggtctggcagggagtgggagaccctggcgtgcatctgcctcaggagcatcacggcagctctccagctgggtggcaagatcaggaacttatactctgactcagagctccaccttcctggccacagcttggcagtagctgggattgctctgggagtggtttgagtgggtagacagatagggtgcatgggcctagatctcttcatatcaaagaaatcacaggtcttcaggtcatagaaatacagggacccgcagggctctggtctttggggtcagcagtctgtagcccccagccactcagaatgaccaggccttcaagggcacagtgggtggcaagaagaggacactggacccacatgactgtaggactagcccgccataatttgggaaagctctatctcttcagcttatagaggtcatggctcatagatgcccctctaggaggatgcgaccgtcgctcccaactccacttcagtttcatggcttggtaccccaggagctgtggccagggaccttcatggggtccctggccacaactcccaaagagaccagggtcagtgctcccaaagctagagggtgaagaaagaaaataattgcccaatacttcgtgagaaagggtctggggcaaccatcccctgtcctccctcctgggaggccaggtggagagagggcgtgtccagcccctgcctggtctcaggacagcttggaggatgcacccgccccgcccagatgattcctatctctagcctggtggctcactgaggggcctgacaagggcagctttgcctgttctgctgcctgactctgtacactgggagtttcctgcctgagctattgcctggggccccacaaccgg

SEQ ID NO: 1111 - DNA, 1560 bp, Homo sapiens
accatttaaagcatgttcatgcatatcttcatttgtggtcttttgttatgtctgttctcaaatcttgtactatattaattggcaacattaatctgtttccacaataattatagttttaaaatttcttttgttcaagatttaaaaatttgtaaaacattgctagtgtttatcagaatttgaatagcgtaaaatttttttaataataatatgaaataaagtaaaataagatactttttactttaaaacaattatgcagaggataattgttgtctagttttcttaatagtaaattagatttatttttaattaagttgtggttgtacattggtgtaaaatgtctgttccttcccccttatatttttctggtttatgcactcagaagataggaaataaccaaatagaaaaagttcagctttattttatttatgtataaaataagaatgtttaatcttccagaaaaatgcattgtttggatttagtttattatctaaacagtaaagcaagatatttaatgtaagcaagtttttctatttaaagaaattagtaattatttcaggcatttgtttttaatgaatattttgaaggtattatggagatactttctccttaagttgcataactgtacattcaatatataccttgcatctctttagcagttatcaaaattttagggctaaaagaccactttgaacaaaatttctagaaactcgttacttacatgctttagcagaaatttaaatcatgaagttaaatctactcagtttctcaaaagcacctgttatctctgacccaaggcctttgtcacagttgattcttttgcttaacacagcagctcttctcccctttcctgctcttttcatttagctaatcactgtttctccttttgagtctctgtgtattaatccagataggttatgttatgatgcattaaaacaaaaagactaaatcttagtgacttggcataacaagctttttattctcattcacacaagcctatcgtggattgacatgtctgtctgtcatgaactgctgtcattaatgtgtcgctttccagttgttccatcttgtgatacttccatcttaacatgtaacccttcaatagctgcacagagaaagacagcatgaaaaatcatgcaacacttttaaagtacttatttctggaagtataatttgcccaagtattcaagaagaagaaggttggtgggcattagtcatgtccactaaaccttgcataaatgaaacattttcttgtctttttttgatctctgttctgccctcagccttctccagatgctctcataaccacgtgttctttctttttcatagtcattattataatgaattgtttgtctaacttttccccttctacattgtaagctccatggctccatgacttctgtgactacatctgctttttctctccactttgtccacattaactggcaaacagtaaccagccaaatatatttattatatattaaatatatatgtgttatatatttaatctatttattaaattaatgaactaatgagtttctatggcttgcaatcttccagtta

SEQ ID NO: 1112 - DNA, 26097 bp, Homo sapiens
acactgtagatgtgcatatttgtctctagttgtgagaacatacaaaataccatgaagggataataccaccatgctaacattggcttcacaggaagctgggcttggaagaaggggtattatattttatacaacctgtaactctgaattgttaaccacaagattatgattctctcataatgtaaacaaaatcaataatgcattaaagtttggctttttaaaaatatataagcaaaaggaaatgggtgatgaagtgtttgagcactgactatgacaatgcttaacctcgtatctggcacatagtaagtgctcagcaaacagtgctttttctttttttcttttctttctttctttctttctttcttttttttttttttttttttgagacggagtctcactctgtcgcccaggctggagtgcagtggcacaatctcggctcagtgcaacctccacccgcagggttctagcaattctcctacctcagcttcccgggtagctgagattacaggcgcccaccaccacgcccagctaatttttttgtatttttagtagagacagggttccgccatgttgtccaggctggtcttgaactcctcaccttaggtgatccacccgtcacggcctcccaaagtgctgggattacaggcatgagcctccgcgcccggccacagtgctttttcttgttacctcagccaattctaacagctgccctctaggaagatcctgctgttccccccattttgcagatgagatcgctgaggcacagagaaaacacacagatgctgggagggggagctggtaaagctcttcaagccgtcagagcccagactctgtcttagccactcccctccacggtccctccagagaaaggaactggggcaagtagaagtaacttgctccgagtcaccagcaaggaagcagcagcgcaggaattcaaatccaggcctctgctgcaagtctctgagcccagcacacacagcacttcccagccttctcaggacacttgtcagacatgcagttttccaagctctcccctggagacctggattcctatggacctggatggggctgagggacctacgttatgaagaagggcctgagaggattctgctcatcagggaagttgggggcacatggcccagggaatggcgccgcccagtggttcctacggcccctgcacacggaatcagccaggacactctaccaacactaagtacgctctgcagccacaaaaacagatgaggtagatttttacaaatcgatgtggaaatgctgtagacagggagttgagtgaaagctgtaagcggtacaacaattcttctagtgtgatatatctaagttatagaagtacaggctaggcagggcgtggtggctcatgcctgtaatcccaacactttgggaggccgaggcaggcagatctcctgaggtcaggagtttaagaccagcctggccaacatggcgaaacactgtctctactaaaaatacaaaaaataaccaggcgtggtggtgcgtgcctgtaatcccagctactcaggaggctgaggcaggagaattgcttgaccccgggaagcagaggttgcagcgagccgagattgtgccgctgcattccagcctgggcaacagggcaagactctgtctcaaaaaaacaaaaacaaaaacaaaacaaaaaacaggccaacagctaaaagaaatgcacgtgtgcactgaaagatacgtacaagaatgttcacaacaacctcttcctaacagctccaaatgggggactactcaaatgtctatcaaccaggaatggataaacaaattgtggcatatttctttaatgaaatactatacggcaataaaaagaacaagctgttggccaggcacagtggctcacgtctgtaatcccaacactttgggagaccaacgtgggaggattgcttgagcccaggagttggagaccagtctgggaaacatagtgaaacctcatctctacaaaaaaatttaaaaattagccaagcctagtggcatatgcctgtagtcccagctactcaagaagctgagggggaaggatcacttgatcccaggagattgaggctgcagtgagccgagatcgcaccactgcactccagcctgggtgacagagtgagaccctggttcagaaaaaaaaaaaaaaaaaaaaaaaaaaaaaaggcatgctggctcactcccataatctcagcactttgggaggccaaggcaggaggatcgcttgagcccaggagttcaagaccagtataggtaacatagcaagactccgtctcaaaaaaattgtttttaagacaaaaaacaaaaaataaataaaaactggactattgatccatacaacaacctggatgaatctcccaacatcaagttgagtgaaagaagccaggcataaaagggcacatactgtgtgattccatttctaggaagctgaagaataggcaaaactaattggaggtaaaagaaaccagtccagtggctacctcgcaggggtgaatactggctgggaaagagcataaaatgtttagatccacttctcagtgcatttatttatttatttatttatttatttatttatttatttaagacagagtctggctctgtcactcaggctggagtgcagtggcgtgatcacagctcactgcaacctccaactcccaggttcaagctattctgcctcagcttcccgagtagccaggaatgcaggcacccgccaccatgcctggctaatttttgtatttttagtagagatggggtttcaccatgttgaccaggctgatctcaaacgcctgacttcaagtgatccgcccacctcagcctcccaaagtgctgggattacaggtgtgagccactgcacctggcctctcagtgcgtttagatgtgtgtgctttcctgtatataaattatacctcagtaaaaaacaagaagttaaaagcttcaaaaataaaataaaaataaaaataacacacatctgtgtgtctgtttagagaaagtgctcccaggatgtactccaagctagtgatggtggttgcctctgtagagggaagtggtgggctgaggctggggagaaagtggagcgctcttttattcttccctgtaaattattctatatggcttgaattttttataatcagcacgaactacttgtaaaaacttttaaagcaactcaaaccttaaaacacaaaaaggaacacacacacacacagagattctccagccccactctaaatgtgctgaatcagaatttccaccaggaacccaagctctggtccaagccctggctccccaccattgcgctcttgcatacccccagtgatggggatcttactgcctccctgggcattggatgtctttctgcctgtgttgcctctggtcctctaccttgaattgggctccccctctgggtctttccatcctcccccccacccactggggcccccatggtgcttacccactgacagggagccacgggccagtttggggagcagccggtcgagctggcgaaaggtgtggaagacatcagctgagtggacgcggtcctgggcctggctttcatgggtgcgtggcagcgcctcaattccgtaaagagtcaggtagccggctctgggggcggcagacagagggtcaggggtcctcctgggacactcatgtgtggccacagctactcacaagagcttcattcatacacccagtgagcaactactaatcctactgtgcgccaaagaccattctgggcactgaacagtcggcagtgaaaaaaacaaaaatccctgtcctcaaggagctgacctctcagcacagggagacagacaacagacgagaggatgagtaaaatgaataatgcgccagctggtgccccgcggcactgtcagacacaaagctgggtagcaggatgggagggcgggggctgtggtgtcaggtgccaggtgagggaggggctggtgtcaagctgacagctgaaggctgagaaggagtcagccatgggcagagcagagggaggggtaggaagcagagcaagcaccaggtgtgatgtcctggggcaggagggagcccggtgctggggagcagcaaggaggctgatgaggctgcagcagagagctcgaggggacggtgctgagatgggggcacagagaaggggaggagatgcctgctcccagggagggattcagggaagacttcctagagaagggagggtctgagctgagatctgcaggatgatcgggggaagcagaagaggaacgtgttcaggcaacaggcacagcctgtgcaaaggcccagagctgagagtgcaaccgtgcctggtgggagaggtgccagctgtggctggtgcaggcactggagccggggtgtgaggcagaggatgggagggcctgggctgtcagggctggccacgcaaggcaggcatttgcagcagtgagaaggttgtgcttgatctgaggggctctgggaggcccgagaaggaggtcagggcctggtcaagtgtgaaaaagggtaagacatgggagctagcatgagctctcatgtgctctcactgaggcacacttacgcacacgcacacgcacacacacaggaccacgctcagaggacgcgccttcacctccagccccctttaaatgccccaggagtccagccccagcccagcgggctgacctcagtcctgggagggaaactgcaggctttcattttgtcatctctgcctcagcagagagtcacaacaaagagacgcaaccaaagccccggggcctcaccctctcaccctccccttgagctcctggatccctgtgcagacaaagaccagagaccaggatctctcaggagaggggttttcccagatgaagagagaatggaagcaggaatgagggtaggtgggggccgagagaggcctgcgtggtccctgctctgtccctcacctgcacagtggtggcagaagttgtaaaggtgcagcccacacactggattcagtccacaaatgtgttttatcaagggagttcctaaaaacaaactaaagcttccttcaaacatttggggaaactcacacaaaatccggatttcctgctcatctcatcttgaaaaaggaatctggctgacctgcggtcccacctggaaacctagcaggagcagagttgcagccgccccttttagacagacacgtgcttgccaggccactgcggtactcccaaggccctgtggtctcggtgacactgcagttgacactggtcatcatttatcatcacacttgcactgttgttttttgctaactcagagaaccatttcccggtacatatatttctaccaaaacaggcaatgaaaaataaaccaaaaaagtaaaccggccgggagaggtggctcacgcctgtaatcctagcactttgggatgccgaggtggttatatcacctgaggtcaggagttcgagaccagcttggccaacatggtgaaaccccctctctactaaaaatacaaaaattagctgggcatggtggcggcacctgtagtcccagctactcaggaggctgaggcgagagaatcgcttgaatctgggaggcggaggttgcagcgagcagagatcgcgccattattgcactccagcctgggcgaaagagcgaaactttgtctttaaaataaaataaaataaaatgaaggaaaagaaaacaaaaagaaaaagtaaacccagaggaccacaaggttttgctctgtggaagcgaagccggcagctccatatcaaaagagcacggctgaagacaggataatcccatatgtaaatacacacacgacccacaggcggcgctagagccacaaagaaaaataaagctgaaccaagctgggtcacaggagggagccatcacgaaaatgggactcaagaaagacctctctgagcaggtggcgctcgcgataaggcttaaacgaagtggggtgggagccacgcagacctgtggggaacagcattcccaggcaagggaacagaaatagcaaaggccacaaagagagagcgtgcctgacctgctcaaggggcagcagagaggtaggtgggaggaggggaggccagggctacaaggtgaggacagaggagaactttgggtgtgactcagtgaggccagggccaacacaggccaggctggtgggtgtaagaggtggcacctcacagttcgggctgcctgaaccggcacccctttcacctctgtgtccctcccatccaactggcccattctctttgtatttcaggggctgctgattgatggcagtggaaaggcctacagctgccaagccagggggcaggagctccagcccaggcctcaggccctgaagacacagttaccgggttacaggtatggatttacgtctgattccccctgagctgattcccctgtgcctgccgctgtaccatggagcctagccagacccagctgcccctgagcctgcctctccccagcctatctctctctgacttctttgtctgcacagggacccaggagccaggagacctgggaggatcactactgtgaacttgctgggtggtttcagctggccctctctggacctcagtccccatcatacaatgcagggtggaccagaccagcatcacccacaccaattacagcccttgacactgtttgcaccaccccagggcaaaacaaaaagaatggggactgttcgtgtgctgagagctgtggctgagagtgcagactctgggaccagccctgtcctgaccccaacacaggcctctgggcaaatgactcaggctctccaggtctcagttttctcatctgtcaaatggaatatgtaaagtcctagcctcctagagcgattgtgagcattaaaagagctgagacacgccgagtctacacatatgcacacacatatcataaatatacccacatgcccatatgtgtcaacgaatgactgccctttatcctagaactatgttgctctaatttcttggaggggttgaaatgtccttttttaaattaaatttaaattaaattaaattctggttggttaagggcatcactaaaatcagggagctgtccttaacaccactctatccctctcactcacgcccacgctcccccatccccaccgctgccccagtcaaatcttccggcagagccagtgaactctatctccaaaagctacccaaattctcaccacctccctgggccaccaccattctctcaccttggtgacacctggcagcctcctgctaggtcctcctgcctccctctccacccctccttacccctacagtccatcctccatccagcagccagagggggctttcaaactaagttagatcatgtcctgcccctgtgcaaacccctgatgtcacccgatcttactcagcataatttccaaagccttccctgacctcccgactgcctgaggcctgcttctgcccacttctctgacctcctgtccaccttccctccttggctctttatgctgtagccacactggccgtctctctgagcttcctcccacctctgggcctttgcacctgctgtttcccctgcctagagtgttggcgtggtgggcactttgcagttaggtcttggctcagaagccagacccccagagcatgaccctgcctcgtcagtcggcctaagaaagccccccagatgctgtcaccccacccgtggatctctgtcatcgtgtttatcactctctgacataactcaattcggcctcccccactggagtgtcagctgtgtgaatttggggacttcatctgtcctgttccctgctgtatccccagagcctggattagtgcccggcactgctgaaggaaggaacgttcggttgtgcagtttttaacatacatttacaagaccagataaaaggttaaggtcccaagttgatctcccaaacattttgttttctgttctgtgaaatcccaaagtctggaagccacaggacaagatgacctctgaagtcttgctctgtgacttcctctctgaatgacctgtaaggtcccatttccagccagtgtctccttttacagttcatgagctaggtcagatgaacagccggggccctggtgcatggcgtctttcctacagtctttgctttgggtgtctcaaattgcttcccccacccacagagtcctcacggttcccttggccactgctcatggctgacacaggtcaaagtgccgggccccagcaggagggtgggggctgcacagcctcacctgagcaggaagctgtaggagaagtcgaggagacccatctcgtgccagccactgcctgcttctgtagcatcgcccaacagcactgcatggaggttggtatacatggcttctgtgagtgcctggagctctctgtggagaagagtcctgaggcaggaaacaaaagcatgaaaatttggcttccaaagggaaatacacacctacaggcacctccctccccaaacctaagggtcccagagctcaagctccccattggcaaagaggtcctgcggaagagtagcttaaataagaggatattattatgactgtcatcgtcaacaatagttcccatctgttatactgagcctaatctcatttcgtcttcagacaaacctgggaataagagttactattatgacacccattttacagatggagaaactcagaaacagagaggaaagtgacttgcccaaggtcacacagccaaagcgggactgaaatcctggtctgcccaactccagcatctgaattcttaaccaggagagtctttccctccctaaggcacacagcttggataagggacccatagcgttctggaagagaaggaactgaaaagcaactcatctctccctgaaatctaaagataggaagatctgttggaatagctgtggtgttccctgactcaggactgccaataagatgtgaccctggccaggcatggtggctcccacctgtaatcccagcactctgggaggccaaggtgggagaatcacttaagtccatgagttcaagaccagcctgggcaacatagtgagactccatctcaacaaaaaataaaatattagccaggggtggtggctcacacctgtagtctcagctactcgagaagctgaggtgggaggatcgcctgagtctaagagttcaagaccagcctgggcaacatagtgagattctgcctttacaaaaatagaataaatacacaaagaatcactagccagatgtgtagtaggtgcctgtagtcccagctactcaggaggctgaggtggggaggattgcttgagtccaggagtttgaagctgcagtgagctatgatcacaccactgcactccagcctaggcaacagagtgagactctgtgtcttaaaaaaagaaaagaaaaaaaaaaaagacatgacctcacatgagagtgacacaaggaaaaagggatgtgggctggagatctggtcccatcgtgtggacctgcacagagtgaggagaggccccgtctggaagagtgtggcagaagctggaagctcccctatactgagcctccatgatatggagtctacactgagccatgactgaggatatgattagaagccaagaaaggggtatcttgcatctaagtctaaggcctctctgctccttgtgtaggatctggaccaaaaaggatatccctacagcaagtgaagtggggtgtccatgggcggtgcacagcccatggtcaacagcaacacctagtggcagcaacaagaacagtgggagagtgccaatcagggccctgatctgtcatgcctgctgtttgggaagtaggatggactgctgtttgggaagtaggatggacacctttagactgagtaagccagaagtgcctgggtaatccaccagggcagggtttgcacagggcgtccatgaactcctgggtatgaaaaggtttgggatgttcaagttggaacatagtgggaaaaacgacagacatggctcatgactcatgtatgacaatgcatgtgaagggttccgcacggtgcctggcacattgtaagtgctcaatacatgggatctggccttcaatggaccctgacccagctcttctccccaccccactccaagcgctggtcctcagcagagacaagccctcaacagatgtggctgctgtgcccagaagacatcacgccagcttgtaagaaattccagaaaattcctgaggcaaacactgaaggaaactgggatcctccctgggtagcaggggcagattcagtgagctgtggattcctattgctaatgggacccccagggtccccctggaatgtcaggacccaggacactcaggctccaagcagctgcccccaggccaaggttcagaggaggcatcatgtctcatcaacatccacttcatcatgctggccttgcttcagccttaactatcttgcaaaacagtttcctagatgctcttcctaacctccagagggtattcctcctggagacagatcactgaagatcgccattggactgtgtgaactctgcaggggcggacacagggtcttatcagccttggtatcttagatgaaggagaatgcgctgtgaagtcagtggacctgggttcaaatcccagtcctgccacttactagcagtagactttgagcaagtcacttcacctctctgagcctcagtgtcctcatctgtaaaataaggataaaaatgcccacctctttaggctaatgcacagatatgaaagtgagcctatcagacacctggcctataatagctgccttcaaatggtggttggcaccgttctgcacaccctacatccagggcaatgaccagggtacaatgggtcctcagatgtctgctgaatgaatgcagagcaaacatgttcatctgttctcttattgatatgatgactccatatgtggctgggcatggtggctcatgcctgtaatcccagcactttgggaagctgaggcgggcagaccacctgaggtcaggagttcgagacctgcctggacaacatgatgaaatcctgtctctactaaaaatacaaaaattagccaggtgtggtggcacgtgcctgtaatcccagctacctgggaggctgaggcaggagaatcgcctgaacccgggaggcggaggttacagtgagccaagattatgccactgcactctggcctgggcaacagagagagactctgtctcaaaaataaataaataaaataaaatgattcctccatatgtttcaggagctgtaccacttctggctatgtggcctgagacaagtcacttctctgagatccagtggctgcatctatgaaatggggctgtaagttacttagcctccagcattgttgtgaagactaatgagataatgcatgctgcctggcagagtatggactcagaaatattcatcattccacctctctccttcattttacagaggaggaaacagaggctcagagagggaaagaggtttgtccaaagtcacaaagctagggagtgatggggctgggatttgaatttaggtgtggctgacccaaaccctggtctcctcctactaaaatcagggctgcctccaaacaaacaaacaaacaaacaaacaaacaaaaaaacccgccagagatgagagacaaagagttcttcttccacccaattcttttgggttgttttttgttttgtttctgtttgtgttctcaagacaaaatgtctttaccgaacatttgctttggaaccaagaataacttgggccacatgagtagaaatgagtcgcccaccctggccctcccacaggtgccatctccagccactcacagtttcatcctggccttttcatcactggggctgtaatgtggaagctgcacatcaaaaatcctctccatgaggaagatggcataggcatggaagtcgagcctggtgcgaggctcccacaccaccgcgtcgtaggagtgtgggtccaggagaacggtgacatacctgcccccaaccagtatctgtgggaagttgccagggatagagtgaggagtgtcactgtgaacagcagccgctctcagtggtcagggccttactgtgtgccaggcactgccccactggacagtaacacactatgttctcttatctatgcctcactaccacctaccaccctgtgaggtagggaccatcactcacccatttatagctgaaaaagtgaggcttagaaaggagaagaaatgtgcccaagatctcatagctgagaagtggcaggactaggactggaatttgggaatattgaggctttttaaaatcaaagactgtgttctctaccacctcactcttaagcacctgccatgattatcttggttattgccatatctccagtagccaggagagaaggcggcagatggatcctgtgcacatcatggatggatggatgaatggatggatgaatggatagatggatggatggttggatggaagaatggatggatggatggatggaaggaaggatggatggataagtagatggatgaatggatgggtggatggatggatggatgaaagaatggatggatggatggaaggaagaatgaatggatacatggatgaatagatggatggatggatggatgctgttgggtaaattccagtgggtggattgtagaagagtaaatgggcagatggatggattggtgaatgggtaaatgaatggaaggaaggaaggaagggagggaggaaggaaggaaggaaggaaggaaattgctgggtaaatacttgtggatacaatgttagatagatggataaatggaaggatagatcaatgaatctatgttggatggaaagatggatggaagggcagctagaggttggttggaaaccaaatgtaccaataaatgttgggtacatggatgagagaatgctaggtagatactgggtaaagtgaaggatgaatgttgattggatggaagttggaaggatacatggaaggtgggtgggtggtggtcgtttgaatagatgttgtaaggatggatggatgagatataaatagatgtatatccagtggggagacatcgaatactgaatatagctgagtgttgggtggatagtggcagatgaacagaaagatgcgtagataaacagaaaaatgaaagttggtggaaactgaccagttatccctcagtatccatggaggattggttccaggacctcctgcagataccaaaatctatggatgctcaagtccttgatttaaaatggcataatatttgcaaataacctacatgcatcctcccatatactttaagtcatctctagattacttataatacctaacacaatgtaaatgctaaataaatagttgttaaactatatttttagggaagaattacaacaaaaaagtctaaaaaagtttagtaccaacacattttcccccaaatattttcaattcgtggccggttgaatccagagatatggaacccacccatggatacagggggccaactgtatacagatgaaagttggatgaacattggatccatgagtggaagaactctgggtagatctgggcagacacatgaagggatagaagatggataaatgaattgacagatgtcgggtgaatctatggaaaaactgatgggtgagtggatagacggaggttgacgaatgaatgctgagtagatataaggatggaaggacgcttagtagacaccaggtggacaggcagaagaatgggatgggaagatggatgttgaacggatggaaatggaatggatagatggaggtcagctgcatggatatacaagtattggatagatattgagtgactgcataactccacgctgggaagagcaagagggagactgaagggatgatgttaggtcagcattgagagtgcagctggacaggcagctggatagaaagttggctcgaccactcagatggatgttggatggtggggtgggggggttggcatagggacatatgttgaaggaatcaacagaaaccagatatgaggcccagctgctcatccccatccctcccgaggcacaagaggcacttacagtaaagatgtcaccgtgcttctccttcatcctcgtgaggaagctggcagcatcttttccaaagtccaaggcataccccaaccaggggatgctgcccaggtccaggggaggctcaccaggtcgcctacagaagccatggcacttgtcaccatttgataaggcaaggaagggcataaagagtgtaggttgcagagtgtgattttgaatggagcagtcggggaggtaatctgaatggagcactcggggactattgcctcacctgctccttttctcttgtaacatgtggatgaccacaccctccctctttcccctccagcccacttttccccctttaaatactgaaaccctcagagtcatctttgaagaaaggcacagaccacagactgtttctgtgattctgtggtttttcttctccctggcattgtccttaaccttggtaaaataaacatctaaattgattgagacctagcttagatactttttagtttacaaattggcgaccatgaagggactccatgtaggtggccctggcctttgacaaatctcctgttggtgtttggtaacagcttggtatctgtcttcattggtcaaaccagtagggctgggagctccctgctgcagagaatcccgaatctctgaaaatttgagatctaagagagctacaatttgagagctaagttttattttgttgtacaactccttttctggagtattacttgcttccaacaaggaaggcaagttttcctgcttccatgacgatggagagcacgtaactcccttctggagtttcaactcacttccaacaaggaaggcaagtttgaagttttttttcctgctttgtagatggtaaagtgcaggccaggcacagtggctgatgcctgtaatcccagcactttgggaggccaaggcaggtggatcacttgaggccaggagttgaagaccggcccggccatcatgatgaaacgtcatctctactgaaaatacaaaaattagccaggcatggtcgtggtgcatgcctgtagtcccagttactcgggaggctgaggcaggagaatcgcttgaacccaggaggaggaggttgcagtgagctgagattgctccattgcactccagccagggcgacaaagcaagactccgtctcaaaaaaaataaaataaaatttaacctgaaagactggttcaggccgtggtgggaagtgggggtcagacatgactcattataccctccagcattcatatcaacacagaccttaagtctgataagaaacctttacatctattcgctctgaagcctgctacctggaggcttcatctgcatgagaaaactttggtcttcacaacctcttattataacccagacatttatttctattgacaataactcttgcaaccaattgccaatcagaaagttttaaaatccacctataacctggaagcaccccccacatcaagttgtcctgtctttctggactggacaaatgtatattgtcaatgtatttgattgatatctcctgtctccctaaaatgtacaaaccgagctgtgccttgaccacgttgggcacatgtcatcaggatctcctgaggctgtgttgtaggccatggtcactcatatttggctcagaataaatctcctcaaatattttacagagtttaactctttttgtcagcagtgtttatgtatgtgtgtgtgtttatgtgtgtgtgtatgcgtgtgtatgtgtgtgtatgcatgtgtatgtgtttgtgtgtgtgtgtgtgtgtgtgtgtgtgtgtgtgtgtgtatgcctttatgctttcttttttctctcctaggttcttgttttttgagaaaaagattttttcttcccagtcgactgaattctgttttctccatttacttctgcctgtctctccttcctcttgccgccctctgctgcataagggacctaaaataatttctaacagcctgggattccttaaagaaaacagagaaggtgccagactccttctggggagaaacctctgtttttccttatgaaaccctaagagtgtaaaaagacaagttcctctcagatcttaaactgattgtttttgtattgcgttatctgatttcttttttttttattaactaaaatagctattactacaggaactactcttgtgtgtttaagagagggagtggttaaaatacttagagaaatgcttttgtaacaaagtgcactgtaaaagcattacatggcttagtctcatgatatctctctccttttagagacccaggattcagtgtggactctgcccagagctcagaggtccagttaaaagacagagactaaatttaaatctacctatctaaataaagtttgtctcctcataaaatcctacagaagatttctataattttatgtttggcttgtggcttggcatccatttttaatctccctctaacacacccagtctctctctccctctttctttctctctctctctctgtctgtctctctctctctttagagatatacatttccctatctgattttcacccaagagttgttcctttagtatgcaagtttggctgacaattgcctagggtaatgaaacaggttatcaagaaattggaagtctaagatagttgtcctttttagacccaggagtcaaacactataacttaacagcaccaggacttaaaaacgatacagaaagtcacatggatgtaataacttttatttaaaattgttttatatcagctttcctaggcaaataaaaacataaaacaacttagacatattaagaaaagccaggagctttataacaggagaaaaaaaggggtcttatgaatcttatcagatctactgctgcctgtctgtctatgtatttatatgtcctgtatataatgtttcactacaaaaaaatacataagaggtctaataaattggcttaaagaaaaaaatcaaatactttatcagaaaaatagaaactttaagcccaaatggtttttcaagctcacatgacttaagtaaatctttaacaaataagctggttttaaaattattggtaaaataaaattagaaatggtttcagaattgtcaatatacattattgttttatatgtattagtcaaggggttatatatttatctctgctagatattataaggtgacaaaatttggcatgaggattatgaagctataaatccagcccaaaagagaattatcattgtgtaactttttgataaataaggcatttaatattgttcatttaatgaaaacagttaaatcctgagttattggcaaaaaacaaaaaacacacatgtatttaactttaaagttcttacttaagtaaacatctgaaattcacagctataaaaatgattaacagggaaataactttaaatagtgactatcacagttttcataagtaatctaggtaaactattttaaaaaattaattaggtaaatgtaatgaaataaatgcttataaataaatgtcatataattcagaatctaaagtgatattaaattaaataatagatacccattaaatgtctgggtcatttccaatttttccttaaaaagttacagaaaaacatttttcttaaaaaagtgttcttattaaaaggaaatagttttgtctaattcaaaggttgtttattaaacaacgtaaaaagaataagtaaataagaagcatgtaaagaaaattataaaggggtatctttggcaagaaaggttaaaagaaaaataattgtatatggaaagaatcccgtaaaaattttttgtcctaaaataaaatgattgatcatttacgaaagagagatgtttaggataaaacaggaagcatgttgtaaatggtttgtgtaagtcataataaggtttataaaaagagaatttatgaaaaacattttatgtgaacaagttgactataattaaaaggaaattatttataatagtctttctagagattgggttttgatattaaaaatgcactaatacactaaagaattggttagaacaaaattttcttaaggtattattttactgttaataacattacatgagattttaatttttttaactcaaaagttcaacttttattgcatcttgctattttcagctttctctcctctttgagaaggactgagagaataattctctccatcaacattttcgtcagctcatataaattttttccctcaggtcctaactgttgtagcctgatgctaaaaatgctttatcataaaggtctaaaggaaatgttttcatccaatataacattctgtgctcctggcatttcttaatatgtctaaattgttctgtgttttgatttgcctaggaaagctgatataaaaaaatttttaatgaaggttattacatccttgtaactttctgtaatgtttttaaagtcctggtgctgtttagttacagggctttgactcctgggtctaaaaaggacactgagtcctgctaaatcttaaacactgacagcagttaaagcatcatcttcagacctaggaggagatgacattcaaaataagctgcatttgtgagacatggagccagaaatgaaaactattcaacctctctaggcccagggactatcatggaagaggtgggcatatgagattgtaagggctgattctgagagattaaattagttcagagtttctctattaattaaacattaacatcaaaggcacactgatgcaagaccagcatctgggctcctgtgtcagattaacaaggttttcttgaagcattatcccaccctttaaaaaattataaaagtttagaaaatggtttatggaaattacatcttagggtcaagatgattaaaatttaatagatttgtttataagatttgagaaacaggatttaattggcctcatgctgtatttattagagcttattatttggaaaattaagtctcctctctcaaagaataaaggtttttaggccaggtgtggtggctcatgcctgtaatcccagcactttgggaagctgaagcgggtggatcacttgaggtcaggagttcaagaccagcctggccaacatggtgaaaccccgtttctactaaaaatacaaaaaaattggctgggtgtggtggcaggtgcctataatcccagctagtcgggagtctgaggcacaagaattgcttgaacctgggaggtggaggttgcagtgagccaagattgcaccactgcactccaacctgggcgacaaagtgagagtgtctcgaaaaaaaaaaagaataaaggtttttgccttttttctgaaatctctgagttatacctttggctaaatgaatgacttattttacaataacctgtgattctattttgtgatgtcaagtgttttaaactttctatatttgacaaactttccaaaataaaatagtcaattcagtccttttgacctcattaattttttggcattaggtcctctgaagtccaaaagagacatattcggcttatttggtaaaataaaatcatacaggaagcattgtcaaatatgaaatggtgtttaatcttctttggattatatttatataaatgagttgcttatataaatgagtatgtgttccaaaattgtatgagattcctgtgattctgatatgacttagtatacatcatcagtagtaattatgattattatgtaaaactattgaataccacagacgtaaccaaatttccttgtcaattgtgtctttaactatggctgttctaagacttttgtcatccacagttgttttagtttgatctttttataggtgatttataatcagctatagaactctgaggagtactcttaaacatgggcttctgacaaccttagagattgtgccattggaatagggagaaaaacttccaggactgtcatggagaactgatgtattcatgaggactgctaatcccatcttgagcagaacaggagttaattgcatgaactgaactaacaggagattgaaataatcttttatgagtttttgtttaaaacatttgttgattctttttgttttgttttacagagtcaagaaaactttctcttcttttaagctatttatagcttttaacaattcagtaaagtatactctcatgagaaaaatttaaaacagaatttctttctctttacctattttttccaaaacttggaaactatttgtgagtattcttaatttatggcaatgtagttatttgcctaagtatcttttttcttttataacagggcataattggagacactggttattttaccaaggctttaactggaatgacatattttcagactactttgagaaaataaggctgaactatagagctaataaaagcaccttggaaaaactggcttcatataccctgtcgtttacagggtcctgacctgtggaaagcaaagaatgtcactttttgaattcactcaattcatacaggtatctgcaggcacagctaaatccttggctgggtgtgaggcttttaaaaaggtctagactcagattccttatggaaaagcttccagcaaagccaattttaaaaagaagagagagctcatatggcaaatgatcagtcttgctgcattttatgaaaataatcaagccaagtataatataactaaaacttattttacaaataagttggtcctactatgattttgtctttaataaaattggggaattggagagagaaaagtcatgtttcaaaattaactatagtacacctgttattagagtctagacttgtctaatgtttttccatttttattattttccacaatttggactgaattctaaaaattctcctggctccaagtctccaaaagaatgttttcaatgttttcccttcttttttttttcctcccctcatttttcctgatgtgaaatcactaaaagttaagctgtgcttttcttaaagccctataaactgaacttaaactttggaagaaaataaaagcaatctctttatatgcagaaatcattttcatacctgcctactgatatacggacttgagagtaatatggcctctatcagttttccaggttcgttctttcttttttgtttatctgcttacttcctccttttttcctgttttctttctctcttattttctttgtgtgatgtgagacttcacaacctactaaaactgagctttcctaacaatgtgggacctattcgtctagaaataaaccatcctagacatgagagatcagacaaaacctgagaccggagattcattttcttctaaaatgctttctccaaaagatcttaaatagaaaaggggggcaggcatacatggtggttcatgcctgtaatcccagcactttgggaggctgagacaggaggatcacttgagcctaggagttcaagaccagcctgggaaacagagtgagaccccgtctctactaaaaattaaaaaaattagcccagcatggtagcacatgtctgtagtcccagctactagggaggctgagacaggaagatcgcttgagtctggaaggttgaggctgcagagcaaaaaacgtgcaggaagaaagaaaagaaaaaaaaaaagaagaaaagaaaagaaaaccagggagaaaagaaaaccggggagaaaggaaaataaaaactcaggacaccaattcactctgccatgaggaaaaaattaaactgaaagctgagtcatgcaagaagctgcctttcctactattcctaagcagatagctacagataaaagtttcagtatctccataggcagctactctatgttcaccttattttatgtaaagtgctgatttactgtgcatgagagaaatacatcattgactatcgccctacccgttccttttctcttgtgacatggggattaccataccttccctctttctcttacagcccacctttcccccgctttaagtattgaaaccctcaaagtcgtctttggagaaaggcacagacctctctactgggcatgtccttaaccttggaaaaagaaacatctaaattgattgagacctgtctcagacactttttggtttacaggtaccacttcacccaccaggatggccataataaaaacaaaaattttaaaaaaggaaaataaggctgggcatggtgtctcatgcctataatcccaacactctgggaggccaaagtgggaggatctcttgatcctaggagttcaagaccagcctgggcaacatggtgagaccctgtctctacaaaaaatacaaaaattagccaggtgtggtggtgtgcacctgtagtcccagctactcaggaggctgagtttgggggatcacttgagcctgggaggtggaagctataatgagctgtgactgtgccactggactacaacctaagcaagagaacgagaccctgttcccaccaccaaaaaagggaagaaaataagtgttagcaaggatgtggagaagtgagaaccctcatacattgctggtgggaatgtaaaatcgtgcagctgctttggaatgcagtctggcagttcctcaaaacgtcaagcatagacttactacaagacccagcaatgtaccctaaagaattgaaaacgttggatcttatacaaatgtatacactattattcgtaagcagtgtcagaggtgttcaaaccagagtgactccatgttgaataggagctgggtaaaatgaggctgagacttgctgggctgcaatcccaagaagaagttagacaatttttttttttttttttgagatggagttttgctcttattgcccaggctggagtgcaatggcgcgatctcagctcactgcaacctccgcctcccaggttcaagtgattctcctgcctcagcctcccaagtagctgggattacaggaatgaacaaccatgcccggctagttttgtatttttagtagagacaggatttcatcatgttggtcaggctggtctcgaactcctgatctcaggtgatccacctgcctccgcttcaccaagtgctgggattagaggcgtgaaccaccatgctgggccaggaagctaggcattcttaagcgcaggatgtttacgatcaagggaacacgttaaatcatgcttacccaacagacccaagacttaacagatccaggacttaacagacccaggaaacatcctgctgtcccgatattttatgaacaaaagccttcttagtttaagaataagttttgctttaaagataataatatagattcttatggaagattgttaggtaacaatcttttgtccccagcccttgtggtagaagagcacacctctcccatgatttttatcttctatataaacaagaagaattgtaactaaggcagacacattcctcctcttgccttcggaaacgccctggtctgtctatggtgtggccactctttcgttcctttaccttcttaataaacttgctttcacgttactctgtgaactcactctaaattatttcttgcctgagatccaagaaccctctcttggggtctggatcaggaccgctttcgggtgacagcagcattattcgtaatagctgaaaagtgaaaacaactcaagtgttcgttgagtgacgaacggataaacagaatgtggtgtatcaatgccacgaaacgttactcagccacaaaaaggaatgaagtactgattcatgctacgatgtgggtgaaccttaaaaacattaagcccagtgaaagaagccagacacaaaaggccacatattgtattaattcatttatatgaactgtccagaattgggaaatcaatagagatagaaagtacattagtggttgcccagggctggaggagggggaaatggggagtgactgctaatgggtacatggtttcttttaggggtgatgaaaatattctggaattagatgatggtgatgattgcacaacccggtggatatactagaaactattgaattatacacttttttttttttttttgagacggaatcttggtctgtcgccaaggctggagtgcaatggcgcgatcttggctcactgcaacctgcacctcccgggttcaagcaattctctgcctcagcctgccgagtagctgggattacaggcacccgccaccacgcccggccaattttttgtatttttagtagagatgggtttcaccatcttggccaggctggtcttgaactcctgaccttgtgatccatctgcctcagcctcccaaagtgctgggattacaggcgtgagccaccatgcccggccgaattatacactttaaaaggggagctggagggccgtggcatgatcatagttgactataacctcaaacgtttggactcacgcaatcctccagcctcagcctcccgagtagctggcactatatataggcacatgccatcacacctgactttgtttttctatttttttatagagacagggtcttgatgtgttgcctaggttgatcttaactcttgggctcaagcactccctgtctcagcctcccatagtgctgggattacaggcatgagccactatgcccagcccaaaagggtgaactaaatgggatatgaattatattccattaaagaaaaaagaaaacagggtggtgtgagacagtgaggggggctggtttacaaaaggtggtcaaggagggcctcctcaggagatgccacgtgagcaaagaccagaaggatgtgaagggagtgctctgggaggggcagggagaagagtgttacaggcagaggcaacagcaagtgcaaaggtactggggtgggagcatgctcggtgaggttttcgagacagcaggagccagcgtggctggagtggagaatgtggggacgagacgtaggcgatgatgctggagatgactttgtggaccacgagggccaaggccaaggtgggagtccggctcctatgccacgcgtggcagggatccactggagggtttgcagcaggagccagtaagtgatgtgaccacacctttaaagggtcataccagagaaagacaagaggaaggaaggagatgtgtcagggaactaccgtgacccccccaggagagcaatgtggtggaagcaatggccatggtccccggggagccagacctaacatctgagtctcccactttcagcacagggccttttgttccacacccagcagttcagggaagcagccacttctcttcctcctttccccctccctctctacctccctctgcccctgtctcctgctccctttttccctctacctggctgcccccagtataacccaaagggtgggacagctcgtgggcaggagcaaatggccagatttgagggccaaggctgggaaggatgggagcagaagcaaagatgaaatttgagggcctaggaagtgcctctcccaaccattccctcctctccccagcccatcccggcttctctagtcaaagaggagacttgcaaatttgagctctgtgagtctaaggaggtgcagggccttgccttgtgcctcatctttttgtgagcccctgggctaaggccacttctcctgaagtctccacgtgtcgtgctgcccaagtagccttggaataactggttcatggcagcccccttccagcccaggtcagagcctggcagactggacccagaagcagtgatttttgcataagaggcaggagggcatggtcacgatgagcccaaactttagcaccatacttcctggcttcaaatcccagccacgcttcttgctggctgtgtgacttagcttctccatgcctctatttcctcatctgtaaaatggaagcaataatgctactgactgcattgggctgtgccaaggatgaggggagttacagagcacctggcacctagtagctgggaagcagctgagaagcaggagcagtaagattcctgggcaccatttacctagtgccaactacacatcaggagctatacttggcattttccaaacgtttccttgtttggaaataatggctaacatttaatgaacgctgatggtgtgggagacaccacactgaggactttatcccagtgactcaatgaatcctccccctaaccttatgaggaagcaattattactgccaggcccattttacagaggaggaaactgaggtgcagagggctaagtcacatgccagagggtccaacatagaggacttgggtttctaatccagacaggtctggctgcagtgcccaccctcttgacactaccctggcccccagtcaccctaagtgggcattttcacctccattttgcag

SEQ ID NO: 1113 - DNA, 84733 bp, Homo sapiens
acggagaaatgcaactatttacttccattcctaattatttcaatatttaggttgccccaaaaatcaaaaaaagacaaaattttaaaaatcttcccactgggaaaacagaggcttgctgtctacttgggattccagtacaatttgctattttgttgttttttttcttttgagacaaggtcttgctctgtcactcaggctggagtgcaatggcgtagtctggctcactgcaccctcaacctcctgggctcaagtgatcctcccacctcagcttcctgagtagttgagactacaggtgtgagccaccacaactggctaattattattattatattttgtagagacaaggtctgtctatattgcccaggctggcctcaaactcctgaacaaaagtgattctcctgccttggcctcccaaagtgctggattacaggtgtgagccactgtgcgcagcctcatgctgtattttaatgtctgcataaaggccaagtgttgttctgggaaacagagtagccgcaagccccagggagttatggagcatttgaaatgcggctggctcgaatgcagccacatttaatatagggtaggggagacactggattccagagtcagcatgagaaacaaaatgtaaaatatcttatcaataattttaacattggttaatgctaaaatgctaataatattttagatgtattggcttaaataaaatgtattattaaaatcgatttcacttctatttttcttttttagtgtgtctaatagaaaattttaaattacaaatgtgattcccattatttgtctatgtacagcactgttctagaaggataacagcaaacagatagcaatagttacctggggatagatttagagggaatgtggtcaaaagagaattttcctttttgaaatatttgatttttttttaacaaaagtcagaggagcccagttaagaggcccagtgctgtagcagagtgcctgaccttgaacaagtcacctcacatctcagcatctcagttttcttgcctgtaaattgggataataaaagtacccaccacagagggttatatacagatcaaatgcgttattaacatctaaagcacagagatgactgacacagtcctaataaacgctatattattaaataacaaatcttactgaatgttagcaaattattagcccaaggagaacatgttcatgaattgcttctttaattaagaaacaataataaattgcgaaatacagagcacaaagtttgaagacagagagcattgaaatcccagctcttccctttctaacgagatgaccttggccaagtcactttgcatctctgagcctcagtttcccccatgtgtaaaatgagggccatctagctcataggatggtcaggaggattcagaaagatcacacacagaacacacttggtatcggtagaagtttgtaaaatgctacttgctacattctctccattattacgaggtatttcttattggtgtgataaccggatgccatgaatgagggctgccaggcccacggtgattggcagcccaccaatttaaaccagattggtgtatctggtttaaatcccagagtccccatgctatgtagcctcggctgagcccctgcccatctctggacctcagtctcctcatccaaaaaatgaggacccagacttgaatacctctcaagttttttctgggaaagccctctaggccctctagatttgggggcatagtacagagaggcccccagaagacacatgtctttaaagtcttgtgttttacctttgaaatgcatcagagttttgcatcagactctgtgattctttgatataagaatgcctttttccccaaaacaatgttcaaataaacagccccccaaaataatccagtaaaataaatgttccagacagaagcactatgcttagctagggggtctgtttaactgtcccctgcccccaactccctactgtatgagaaacaccagactcaatggcctaagggttctcaaaggattaactttcttttaaaatatatttatactttaaaaagtgaaggaagaataatgtatgcatacagaaaaaaaagaagaaaaataaagaatctaagagttcaagtccacatcttgtaaaaaatgattttctctccaccccttctcggccttcccaaaggcaaaaatctatacatactcccacatttttaaaaatggccgggtgtggtggctcacaccggtaatcctagcactttgggaggctgaagcaggcagatcacttgaggtcaggagttcaaaaccagcctggccaatgtgatgaaaccccagctctactaaaaaagtacaaacacattatccgggggtggtggtacgtgcctgtaatcccagctactcggggggctgaggcaggagaattgcttgaacctgggaggcagaggttgcagtgagctaagatcgtgccactgcactccaacctgggcaacagagcaagactctgtctcaaaagcaaaaacatatatatatatatataaaatgtatgtatatatagtgatatagtataccctctgcctgcagcttgctcttttttgtaacagtagatttcattcactaccagtatgtcccactctgttttagatgcatagatggcctttagatgaatgcataatttatttaatcagcccttactgatggactttaaattgtttctagcatttgcaattataagcaatgtgacaatgaatatgtttgtgtatctgtagacatgtgcaagcatttatgtaggataaattcctagaagtggaagtacaggatcaaaggaatgtgcattttattttatgtttcagcaggttctgccaaaagaggctgcaatgcttcaagcaccccacagcaatgttcgggggctgctttgcccacatgcctctggtcccaattaagatgagaaatcaccgtcccacattgccacctgctgctcatattgagaaatgcatccttcctatagccagcccagggctgctcccagagtgatggggggagttcctctgcgtctaatcagactcctctggagcatctgtgtggaggaaatggtaatggagaaacccaatttttcctggggaagcaatcagtgctaggatgtggcaggtgctttatgcacaggattttgcagacagacagaccaagtttccacctaccagctgcatgtctatgacaagtgatctcacctctctgagcctcagtttccttatctgcaacatgggtatgtgaataacaaccttccagcatggatggcaagatttgataagctcaaatgagttcctctaaaaagataataaaggacacaaacagccggctcataaacaggaaatgcaaatggctactgaaacacaaaaaaatacaaaaattaaccaggctcagtggcacgtgcctgtagtcccagctacttgggaggctgagttgggaggatcgcttgagcctgggaggtcaagattgcagtgagccgaggtctcgctactgcactccagtctgggtgacagagcaagactctgtttcaaaacaacaaaaaaaccacacacacccagagatgtttcatcacagtagtcagtgatatgccacatagagccagatgtccttttttccatcagattggcaattatttaaaggctgataactgcatgttggcaaggttgtggtaacatgcaaattaaagcaataagttacccacctctgcccatcagattagcaaataaatggaaagattgatggcatctggtggagcagatttcttccctttaggtaggcggatgaattgctctgtggttttggaaatgatgtggcagaagcagataaaaattttaatgtatagggcctttgacctggcaaaaccacttctaagaagtgggcagagagaaatgaaataaccagatggtagaacagatacaagtacaatgaaatggtataaaagcaaaaagaaagaaagatagaatattgacatctgtcagagggaaatggctaactactgaaacagccatgtgagggctaaaaaaatgtattggttttttgtttttgtttttgttttgagatggagtcttgctctgtcacccaggctggagtgcagtggcgtgatcttggctcactgtaacctctgtctcaccaggctcaagtgatcctcccacctcagcctcccaagtaggtgggattacaggcgcttgccgccatgcccggctaattttttgtatttttggtagagatggggtttcgccatgttggccaggctggtcgcaaactcctgacctcaagtgatctacctgtctcagcctcccaaagtgctaagattacaggcatgagccaccgtgctcggccagatgtcttgtatttttaatgttaatttcatatccttctactttgctggattcatttattgctggagtttgttttattattgattttctggggttctccaggtacaatatcagatcatctgcaaataggaatagttttacttctttacccattctgatgtctataattggtttctcttgtttaattgcatcagctaatatctctaaaagatgtttatatcaacagagaagaatgtacagctatattgttaggttaaaaacaggttgtaaataacagatacaatttttctttgtaaacacagagacactgtagatgtgcatatttgtctctagttgtgagaacatacaaaataccatgaagggataataccaccatgctaacattggcttcacaggaagctgggcttggaagaaggggtattatattttatacaacctgtaactctgaattgttaaccacaagattatgattctctcataatgtaaacaaaatcaataatgcattaaagtttggctttttaaaaatatataagcaaaaggaaatgggtgatgaagtgtttgagcactgactatgacaatgcttaacctcgtatctggcacatagtaagtgctcagcaaacagtgctttttctttttttcttttctttctttctttctttctttcttttttttttttttttttttgagacggagtctcactctgtcgcccaggctggagtgcagtggcacaatctcggctcagtgcaacctccacccgcagggttctagcaattctcctacctcagcttcccgggtagctgagattacaggcgcccaccaccacgcccagctaatttttttgtatttttagtagagacagggttccgccatgttgtccaggctggtcttgaactcctcaccttaggtgatccacccgtcacggcctcccaaagtgctgggattacaggcatgagcctccgcgcccggccacagtgctttttcttgttacctcagccaattctaacagctgccctctaggaagatcctgctgttccccccattttgcagatgagatcgctgaggcacagagaaaacacacagatgctgggagggggagctggtaaagctcttcaagccgtcagagcccagactctgtcttagccactcccctccacggtccctccagagaaaggaactggggcaagtagaagtaacttgctccgagtcaccagcaaggaagcagcagcgcaggaattcaaatccaggcctctgctgcaagtctctgagcccagcacacacagcacttcccagccttctcaggacacttgtcagacatgcagttttccaagctctcccctggagacctggattcctatggacctggatggggctgagggacctacgttatgaagaagggcctgagaggattctgctcatcagggaagttgggggcacatggcccagggaatggcgccgcccagtggttcctacggcccctgcacacggaatcagccaggacactctaccaacactaagtacgctctgcagccacaaaaacagatgaggtagatttttacaaatcgatgtggaaatgctgtagacagggagttgagtgaaagctgtaagcggtacaacaattcttctagtgtgatatatctaagttatagaagtacaggctaggcagggcgtggtggctcatgcctgtaatcccaacactttgggaggccgaggcaggcagatctcctgaggtcaggagtttaagaccagcctggccaacatggcgaaacactgtctctactaaaaatacaaaaaataaccaggcgtggtggtgcgtgcctgtaatcccagctactcaggaggctgaggcaggagaattgcttgaccccgggaagcagaggttgcagcgagccgagattgtgccgctgcattccagcctgggcaacagggcaagactctgtctcaaaaaaacaaaaacaaaaacaaaacaaaaaacaggccaacagctaaaagaaatgcacgtgtgcactgaaagatacgtacaagaatgttcacaacaacctcttcctaacagctccaaatgggggactactcaaatgtctatcaaccaggaatggataaacaaattgtggcatatttctttaatgaaatactatacggcaataaaaagaacaagctgttggccaggcacagtggctcacgtctgtaatcccaacactttgggagaccaacgtgggaggattgcttgagcccaggagttggagaccagtctgggaaacatagtgaaacctcatctctacaaaaaaatttaaaaattagccaagcctagtggcatatgcctgtagtcccagctactcaagaagctgagggggaaggatcacttgatcccaggagattgaggctgcagtgagccgagatcgcaccactgcactccagcctgggtgacagagtgagaccctggttcagaaaaaaaaaaaaaaaaaaaaaaaaaaaaaaggcatgctggctcactcccataatctcagcactttgggaggccaaggcaggaggatcgcttgagcccaggagttcaagaccagtataggtaacatagcaagactccgtctcaaaaaaattgtttttaagacaaaaaacaaaaaataaataaaaactggactattgatccatacaacaacctggatgaatctcccaacatcaagttgagtgaaagaagccaggcataaaagggcacatactgtgtgattccatttctaggaagctgaagaataggcaaaactaattggaggtaaaagaaaccagtccagtggctacctcgcaggggtgaatactggctgggaaagagcataaaatgtttagatccacttctcagtgcatttatttatttatttatttatttatttatttatttatttaagacagagtctggctctgtcactcaggctggagtgcagtggcgtgatcacagctcactgcaacctccaactcccaggttcaagctattctgcctcagcttcccgagtagccaggaatgcaggcacccgccaccatgcctggctaatttttgtatttttagtagagatggggtttcaccatgttgaccaggctgatctcaaacgcctgacttcaagtgatccgcccacctcagcctcccaaagtgctgggattacaggtgtgagccactgcacctggcctctcagtgcgtttagatgtgtgtgctttcctgtatataaattatacctcagtaaaaaacaagaagttaaaagcttcaaaaataaaataaaaataaaaataacacacatctgtgtgtctgtttagagaaagtgctcccaggatgtactccaagctagtgatggtggttgcctctgtagagggaagtggtgggctgaggctggggagaaagtggagcgctcttttattcttccctgtaaattattctatatggcttgaattttttataatcagcacgaactacttgtaaaaacttttaaagcaactcaaaccttaaaacacaaaaaggaacacacacacacacagagattctccagccccactctaaatgtgctgaatcagaatttccaccaggaacccaagctctggtccaagccctggctccccaccattgcgctcttgcatacccccagtgatggggatcttactgcctccctgggcattggatgtctttctgcctgtgttgcctctggtcctctaccttgaattgggctccccctctgggtctttccatcctcccccccacccactggggcccccatggtgcttacccactgacagggagccacgggccagtttggggagcagccggtcgagctggcgaaaggtgtggaagacatcagctgagtggacgcggtcctgggcctggctttcatgggtgcgtggcagcgcctcaattccgtaaagagtcaggtagccggctctgggggcggcagacagagggtcaggggtcctcctgggacactcatgtgtggccacagctactcacaagagcttcattcatacacccagtgagcaactactaatcctactgtgcgccaaagaccattctgggcactgaacagtcggcagtgaaaaaaacaaaaatccctgtcctcaaggagctgacctctcagcacagggagacagacaacagacgagaggatgagtaaaatgaataatgcgccagctggtgccccgcggcactgtcagacacaaagctgggtagcaggatgggagggcgggggctgtggtgtcaggtgccaggtgagggaggggctggtgtcaagctgacagctgaaggctgagaaggagtcagccatgggcagagcagagggaggggtaggaagcagagcaagcaccaggtgtgatgtcctggggcaggagggagcccggtgctggggagcagcaaggaggctgatgaggctgcagcagagagctcgaggggacggtgctgagatgggggcacagagaaggggaggagatgcctgctcccagggagggattcagggaagacttcctagagaagggagggtctgagctgagatctgcaggatgatcgggggaagcagaagaggaacgtgttcaggcaacaggcacagcctgtgcaaaggcccagagctgagagtgcaaccgtgcctggtgggagaggtgccagctgtggctggtgcaggcactggagccggggtgtgaggcagaggatgggagggcctgggctgtcagggctggccacgcaaggcaggcatttgcagcagtgagaaggttgtgcttgatctgaggggctctgggaggcccgagaaggaggtcagggcctggtcaagtgtgaaaaagggtaagacatgggagctagcatgagctctcatgtgctctcactgaggcacacttacgcacacgcacacgcacacacacaggaccacgctcagaggacgcgccttcacctccagccccctttaaatgccccaggagtccagccccagcccagcgggctgacctcagtcctgggagggaaactgcaggctttcattttgtcatctctgcctcagcagagagtcacaacaaagagacgcaaccaaagccccggggcctcaccctctcaccctccccttgagctcctggatccctgtgcagacaaagaccagagaccaggatctctcaggagaggggttttcccagatgaagagagaatggaagcaggaatgagggtaggtgggggccgagagaggcctgcgtggtccctgctctgtccctcacctgcacagtggtggcagaagttgtaaaggtgcagcccacacactggattcagtccacaaatgtgttttatcaagggagttcctaaaaacaaactaaagcttccttcaaacatttggggaaactcacacaaaatccggatttcctgctcatctcatcttgaaaaaggaatctggctgacctgcggtcccacctggaaacctagcaggagcagagttgcagccgccccttttagacagacacgtgcttgccaggccactgcggtactcccaaggccctgtggtctcggtgacactgcagttgacactggtcatcatttatcatcacacttgcactgttgttttttgctaactcagagaaccatttcccggtacatatatttctaccaaaacaggcaatgaaaaataaaccaaaaaagtaaaccggccgggagaggtggctcacgcctgtaatcctagcactttgggatgccgaggtggttatatcacctgaggtcaggagttcgagaccagcttggccaacatggtgaaaccccctctctactaaaaatacaaaaattagctgggcatggtggcggcacctgtagtcccagctactcaggaggctgaggcgagagaatcgcttgaatctgggaggcggaggttgcagcgagcagagatcgcgccattattgcactccagcctgggcgaaagagcgaaactttgtctttaaaataaaataaaataaaatgaaggaaaagaaaacaaaaagaaaaagtaaacccagaggaccacaaggttttgctctgtggaagcgaagccggcagctccatatcaaaagagcacggctgaagacaggataatcccatatgtaaatacacacacgacccacaggcggcgctagagccacaaagaaaaataaagctgaaccaagctgggtcacaggagggagccatcacgaaaatgggactcaagaaagacctctctgagcaggtggcgctcgcgataaggcttaaacgaagtggggtgggagccacgcagacctgtggggaacagcattcccaggcaagggaacagaaatagcaaaggccacaaagagagagcgtgcctgacctgctcaaggggcagcagagaggtaggtgggaggaggggaggccagggctacaaggtgaggacagaggagaactttgggtgtgactcagtgaggccagggccaacacaggccaggctggtgggtgtaagaggtggcacctcacagttcgggctgcctgaaccggcacccctttcacctctgtgtccctcccatccaactggcccattctctttgtatttcaggggctgctgattgatggcagtggaaaggcctacagctgccaagccagggggcaggagctccagcccaggcctcaggccctgaagacacagttaccgggttacaggtatggatttacgtctgattccccctgagctgattcccctgtgcctgccgctgtaccatggagcctagccagacccagctgcccctgagcctgcctctccccagcctatctctctctgacttctttgtctgcacagggacccaggagccaggagacctgggaggatcactactgtgaacttgctgggtggtttcagctggccctctctggacctcagtccccatcatacaatgcagggtggaccagaccagcatcacccacaccaattacagcccttgacactgtttgcaccaccccagggcaaaacaaaaagaatggggactgttcgtgtgctgagagctgtggctgagagtgcagactctgggaccagccctgtcctgaccccaacacaggcctctgggcaaatgactcaggctctccaggtctcagttttctcatctgtcaaatggaatatgtaaagtcctagcctcctagagcgattgtgagcattaaaagagctgagacacgccgagtctacacatatgcacacacatatcataaatatacccacatgcccatatgtgtcaacgaatgactgccctttatcctagaactatgttgctctaatttcttggaggggttgaaatgtccttttttaaattaaatttaaattaaattaaattctggttggttaagggcatcactaaaatcagggagctgtccttaacaccactctatccctctcactcacgcccacgctcccccatccccaccgctgccccagtcaaatcttccggcagagccagtgaactctatctccaaaagctacccaaattctcaccacctccctgggccaccaccattctctcaccttggtgacacctggcagcctcctgctaggtcctcctgcctccctctccacccctccttacccctacagtccatcctccatccagcagccagagggggctttcaaactaagttagatcatgtcctgcccctgtgcaaacccctgatgtcacccgatcttactcagcataatttccaaagccttccctgacctcccgactgcctgaggcctgcttctgcccacttctctgacctcctgtccaccttccctccttggctctttatgctgtagccacactggccgtctctctgagcttcctcccacctctgggcctttgcacctgctgtttcccctgcctagagtgttggcgtggtgggcactttgcagttaggtcttggctcagaagccagacccccagagcatgaccctgcctcgtcagtcggcctaagaaagccccccagatgctgtcaccccacccgtggatctctgtcatcgtgtttatcactctctgacataactcaattcggcctcccccactggagtgtcagctgtgtgaatttggggacttcatctgtcctgttccctgctgtatccccagagcctggattagtgcccggcactgctgaaggaaggaacgttcggttgtgcagtttttaacatacatttacaagaccagataaaaggttaaggtcccaagttgatctcccaaacattttgttttctgttctgtgaaatcccaaagtctggaagccacaggacaagatgacctctgaagtcttgctctgtgacttcctctctgaatgacctgtaaggtcccatttccagccagtgtctccttttacagttcatgagctaggtcagatgaacagccggggccctggtgcatggcgtctttcctacagtctttgctttgggtgtctcaaattgcttcccccacccacagagtcctcacggttcccttggccactgctcatggctgacacaggtcaaagtgccgggccccagcaggagggtgggggctgcacagcctcacctgagcaggaagctgtaggagaagtcgaggagacccatctcgtgccagccactgcctgcttctgtagcatcgcccaacagcactgcatggaggttggtatacatggcttctgtgagtgcctggagctctctgtggagaagagtcctgaggcaggaaacaaaagcatgaaaatttggcttccaaagggaaatacacacctacaggcacctccctccccaaacctaagggtcccagagctcaagctccccattggcaaagaggtcctgcggaagagtagcttaaataagaggatattattatgactgtcatcgtcaacaatagttcccatctgttatactgagcctaatctcatttcgtcttcagacaaacctgggaataagagttactattatgacacccattttacagatggagaaactcagaaacagagaggaaagtgacttgcccaaggtcacacagccaaagcgggactgaaatcctggtctgcccaactccagcatctgaattcttaaccaggagagtctttccctccctaaggcacacagcttggataagggacccatagcgttctggaagagaaggaactgaaaagcaactcatctctccctgaaatctaaagataggaagatctgttggaatagctgtggtgttccctgactcaggactgccaataagatgtgaccctggccaggcatggtggctcccacctgtaatcccagcactctgggaggccaaggtgggagaatcacttaagtccatgagttcaagaccagcctgggcaacatagtgagactccatctcaacaaaaaataaaatattagccaggggtggtggctcacacctgtagtctcagctactcgagaagctgaggtgggaggatcgcctgagtctaagagttcaagaccagcctgggcaacatagtgagattctgcctttacaaaaatagaataaatacacaaagaatcactagccagatgtgtagtaggtgcctgtagtcccagctactcaggaggctgaggtggggaggattgcttgagtccaggagtttgaagctgcagtgagctatgatcacaccactgcactccagcctaggcaacagagtgagactctgtgtcttaaaaaaagaaaagaaaaaaaaaaaagacatgacctcacatgagagtgacacaaggaaaaagggatgtgggctggagatctggtcccatcgtgtggacctgcacagagtgaggagaggccccgtctggaagagtgtggcagaagctggaagctcccctatactgagcctccatgatatggagtctacactgagccatgactgaggatatgattagaagccaagaaaggggtatcttgcatctaagtctaaggcctctctgctccttgtgtaggatctggaccaaaaaggatatccctacagcaagtgaagtggggtgtccatgggcggtgcacagcccatggtcaacagcaacacctagtggcagcaacaagaacagtgggagagtgccaatcagggccctgatctgtcatgcctgctgtttgggaagtaggatggactgctgtttgggaagtaggatggacacctttagactgagtaagccagaagtgcctgggtaatccaccagggcagggtttgcacagggcgtccatgaactcctgggtatgaaaaggtttgggatgttcaagttggaacatagtgggaaaaacgacagacatggctcatgactcatgtatgacaatgcatgtgaagggttccgcacggtgcctggcacattgtaagtgctcaatacatgggatctggccttcaatggaccctgacccagctcttctccccaccccactccaagcgctggtcctcagcagagacaagccctcaacagatgtggctgctgtgcccagaagacatcacgccagcttgtaagaaattccagaaaattcctgaggcaaacactgaaggaaactgggatcctccctgggtagcaggggcagattcagtgagctgtggattcctattgctaatgggacccccagggtccccctggaatgtcaggacccaggacactcaggctccaagcagctgcccccaggccaaggttcagaggaggcatcatgtctcatcaacatccacttcatcatgctggccttgcttcagccttaactatcttgcaaaacagtttcctagatgctcttcctaacctccagagggtattcctcctggagacagatcactgaagatcgccattggactgtgtgaactctgcaggggcggacacagggtcttatcagccttggtatcttagatgaaggagaatgcgctgtgaagtcagtggacctgggttcaaatcccagtcctgccacttactagcagtagactttgagcaagtcacttcacctctctgagcctcagtgtcctcatctgtaaaataaggataaaaatgcccacctctttaggctaatgcacagatatgaaagtgagcctatcagacacctggcctataatagctgccttcaaatggtggttggcaccgttctgcacaccctacatccagggcaatgaccagggtacaatgggtcctcagatgtctgctgaatgaatgcagagcaaacatgttcatctgttctcttattgatatgatgactccatatgtggctgggcatggtggctcatgcctgtaatcccagcactttgggaagctgaggcgggcagaccacctgaggtcaggagttcgagacctgcctggacaacatgatgaaatcctgtctctactaaaaatacaaaaattagccaggtgtggtggcacgtgcctgtaatcccagctacctgggaggctgaggcaggagaatcgcctgaacccgggaggcggaggttacagtgagccaagattatgccactgcactctggcctgggcaacagagagagactctgtctcaaaaataaataaataaaataaaatgattcctccatatgtttcaggagctgtaccacttctggctatgtggcctgagacaagtcacttctctgagatccagtggctgcatctatgaaatggggctgtaagttacttagcctccagcattgttgtgaagactaatgagataatgcatgctgcctggcagagtatggactcagaaatattcatcattccacctctctccttcattttacagaggaggaaacagaggctcagagagggaaagaggtttgtccaaagtcacaaagctagggagtgatggggctgggatttgaatttaggtgtggctgacccaaaccctggtctcctcctactaaaatcagggctgcctccaaacaaacaaacaaacaaacaaacaaacaaaaaaacccgccagagatgagagacaaagagttcttcttccacccaattcttttgggttgttttttgttttgtttctgtttgtgttctcaagacaaaatgtctttaccgaacatttgctttggaaccaagaataacttgggccacatgagtagaaatgagtcgcccaccctggccctcccacaggtgccatctccagccactcacagtttcatcctggccttttcatcactggggctgtaatgtggaagctgcacatcaaaaatcctctccatgaggaagatggcataggcatggaagtcgagcctggtgcgaggctcccacaccaccgcgtcgtaggagtgtgggtccaggagaacggtgacatacctgcccccaaccagtatctgtgggaagttgccagggatagagtgaggagtgtcactgtgaacagcagccgctctcagtggtcagggccttactgtgtgccaggcactgccccactggacagtaacacactatgttctcttatctatgcctcactaccacctaccaccctgtgaggtagggaccatcactcacccatttatagctgaaaaagtgaggcttagaaaggagaagaaatgtgcccaagatctcatagctgagaagtggcaggactaggactggaatttgggaatattgaggctttttaaaatcaaagactgtgttctctaccacctcactcttaagcacctgccatgattatcttggttattgccatatctccagtagccaggagagaaggcggcagatggatcctgtgcacatcatggatggatggatgaatggatggatgaatggatagatggatggatggttggatggaagaatggatggatggatggatggaaggaaggatggatggataagtagatggatgaatggatgggtggatggatggatggatgaaagaatggatggatggatggaaggaagaatgaatggatacatggatgaatagatggatggatggatggatgctgttgggtaaattccagtgggtggattgtagaagagtaaatgggcagatggatggattggtgaatgggtaaatgaatggaaggaaggaaggaagggagggaggaaggaaggaaggaaggaaggaaattgctgggtaaatacttgtggatacaatgttagatagatggataaatggaaggatagatcaatgaatctatgttggatggaaagatggatggaagggcagctagaggttggttggaaaccaaatgtaccaataaatgttgggtacatggatgagagaatgctaggtagatactgggtaaagtgaaggatgaatgttgattggatggaagttggaaggatacatggaaggtgggtgggtggtggtcgtttgaatagatgttgtaaggatggatggatgagatataaatagatgtatatccagtggggagacatcgaatactgaatatagctgagtgttgggtggatagtggcagatgaacagaaagatgcgtagataaacagaaaaatgaaagttggtggaaactgaccagttatccctcagtatccatggaggattggttccaggacctcctgcagataccaaaatctatggatgctcaagtccttgatttaaaatggcataatatttgcaaataacctacatgcatcctcccatatactttaagtcatctctagattacttataatacctaacacaatgtaaatgctaaataaatagttgttaaactatatttttagggaagaattacaacaaaaaagtctaaaaaagtttagtaccaacacattttcccccaaatattttcaattcgtggccggttgaatccagagatatggaacccacccatggatacagggggccaactgtatacagatgaaagttggatgaacattggatccatgagtggaagaactctgggtagatctgggcagacacatgaagggatagaagatggataaatgaattgacagatgtcgggtgaatctatggaaaaactgatgggtgagtggatagacggaggttgacgaatgaatgctgagtagatataaggatggaaggacgcttagtagacaccaggtggacaggcagaagaatgggatgggaagatggatgttgaacggatggaaatggaatggatagatggaggtcagctgcatggatatacaagtattggatagatattgagtgactgcataactccacgctgggaagagcaagagggagactgaagggatgatgttaggtcagcattgagagtgcagctggacaggcagctggatagaaagttggctcgaccactcagatggatgttggatggtggggtgggggggttggcatagggacatatgttgaaggaatcaacagaaaccagatatgaggcccagctgctcatccccatccctcccgaggcacaagaggcacttacagtaaagatgtcaccgtgcttctccttcatcctcgtgaggaagctggcagcatcttttccaaagtccaaggcataccccaaccaggggatgctgcccaggtccaggggaggctcaccaggtcgcctacagaagccatggcacttgtcaccatttgataaggcaaggaagggcataaagagtgtaggttgcagagtgtgattttgaatggagcagtcggggaggtaatctgaatggagcactcggggactattgcctcacctgctccttttctcttgtaacatgtggatgaccacaccctccctctttcccctccagcccacttttccccctttaaatactgaaaccctcagagtcatctttgaagaaaggcacagaccacagactgtttctgtgattctgtggtttttcttctccctggcattgtccttaaccttggtaaaataaacatctaaattgattgagacctagcttagatactttttagtttacaaattggcgaccatgaagggactccatgtaggtggccctggcctttgacaaatctcctgttggtgtttggtaacagcttggtatctgtcttcattggtcaaaccagtagggctgggagctccctgctgcagagaatcccgaatctctgaaaatttgagatctaagagagctacaatttgagagctaagttttattttgttgtacaactccttttctggagtattacttgcttccaacaaggaaggcaagttttcctgcttccatgacgatggagagcacgtaactcccttctggagtttcaactcacttccaacaaggaaggcaagtttgaagttttttttcctgctttgtagatggtaaagtgcaggccaggcacagtggctgatgcctgtaatcccagcactttgggaggccaaggcaggtggatcacttgaggccaggagttgaagaccggcccggccatcatgatgaaacgtcatctctactgaaaatacaaaaattagccaggcatggtcgtggtgcatgcctgtagtcccagttactcgggaggctgaggcaggagaatcgcttgaacccaggaggaggaggttgcagtgagctgagattgctccattgcactccagccagggcgacaaagcaagactccgtctcaaaaaaaataaaataaaatttaacctgaaagactggttcaggccgtggtgggaagtgggggtcagacatgactcattataccctccagcattcatatcaacacagaccttaagtctgataagaaacctttacatctattcgctctgaagcctgctacctggaggcttcatctgcatgagaaaactttggtcttcacaacctcttattataacccagacatttatttctattgacaataactcttgcaaccaattgccaatcagaaagttttaaaatccacctataacctggaagcaccccccacatcaagttgtcctgtctttctggactggacaaatgtatattgtcaatgtatttgattgatatctcctgtctccctaaaatgtacaaaccgagctgtgccttgaccacgttgggcacatgtcatcaggatctcctgaggctgtgttgtaggccatggtcactcatatttggctcagaataaatctcctcaaatattttacagagtttaactctttttgtcagcagtgtttatgtatgtgtgtgtgtttatgtgtgtgtgtatgcgtgtgtatgtgtgtgtatgcatgtgtatgtgtttgtgtgtgtgtgtgtgtgtgtgtgtgtgtgtgtgtgtgtatgcctttatgctttcttttttctctcctaggttcttgttttttgagaaaaagattttttcttcccagtcgactgaattctgttttctccatttacttctgcctgtctctccttcctcttgccgccctctgctgcataagggacctaaaataatttctaacagcctgggattccttaaagaaaacagagaaggtgccagactccttctggggagaaacctctgtttttccttatgaaaccctaagagtgtaaaaagacaagttcctctcagatcttaaactgattgtttttgtattgcgttatctgatttcttttttttttattaactaaaatagctattactacaggaactactcttgtgtgtttaagagagggagtggttaaaatacttagagaaatgcttttgtaacaaagtgcactgtaaaagcattacatggcttagtctcatgatatctctctccttttagagacccaggattcagtgtggactctgcccagagctcagaggtccagttaaaagacagagactaaatttaaatctacctatctaaataaagtttgtctcctcataaaatcctacagaagatttctataattttatgtttggcttgtggcttggcatccatttttaatctccctctaacacacccagtctctctctccctctttctttctctctctctctctgtctgtctctctctctctttagagatatacatttccctatctgattttcacccaagagttgttcctttagtatgcaagtttggctgacaattgcctagggtaatgaaacaggttatcaagaaattggaagtctaagatagttgtcctttttagacccaggagtcaaacactataacttaacagcaccaggacttaaaaacgatacagaaagtcacatggatgtaataacttttatttaaaattgttttatatcagctttcctaggcaaataaaaacataaaacaacttagacatattaagaaaagccaggagctttataacaggagaaaaaaaggggtcttatgaatcttatcagatctactgctgcctgtctgtctatgtatttatatgtcctgtatataatgtttcactacaaaaaaatacataagaggtctaataaattggcttaaagaaaaaaatcaaatactttatcagaaaaatagaaactttaagcccaaatggtttttcaagctcacatgacttaagtaaatctttaacaaataagctggttttaaaattattggtaaaataaaattagaaatggtttcagaattgtcaatatacattattgttttatatgtattagtcaaggggttatatatttatctctgctagatattataaggtgacaaaatttggcatgaggattatgaagctataaatccagcccaaaagagaattatcattgtgtaactttttgataaataaggcatttaatattgttcatttaatgaaaacagttaaatcctgagttattggcaaaaaacaaaaaacacacatgtatttaactttaaagttcttacttaagtaaacatctgaaattcacagctataaaaatgattaacagggaaataactttaaatagtgactatcacagttttcataagtaatctaggtaaactattttaaaaaattaattaggtaaatgtaatgaaataaatgcttataaataaatgtcatataattcagaatctaaagtgatattaaattaaataatagatacccattaaatgtctgggtcatttccaatttttccttaaaaagttacagaaaaacatttttcttaaaaaagtgttcttattaaaaggaaatagttttgtctaattcaaaggttgtttattaaacaacgtaaaaagaataagtaaataagaagcatgtaaagaaaattataaaggggtatctttggcaagaaaggttaaaagaaaaataattgtatatggaaagaatcccgtaaaaattttttgtcctaaaataaaatgattgatcatttacgaaagagagatgtttaggataaaacaggaagcatgttgtaaatggtttgtgtaagtcataataaggtttataaaaagagaatttatgaaaaacattttatgtgaacaagttgactataattaaaaggaaattatttataatagtctttctagagattgggttttgatattaaaaatgcactaatacactaaagaattggttagaacaaaattttcttaaggtattattttactgttaataacattacatgagattttaatttttttaactcaaaagttcaacttttattgcatcttgctattttcagctttctctcctctttgagaaggactgagagaataattctctccatcaacattttcgtcagctcatataaattttttccctcaggtcctaactgttgtagcctgatgctaaaaatgctttatcataaaggtctaaaggaaatgttttcatccaatataacattctgtgctcctggcatttcttaatatgtctaaattgttctgtgttttgatttgcctaggaaagctgatataaaaaaatttttaatgaaggttattacatccttgtaactttctgtaatgtttttaaagtcctggtgctgtttagttacagggctttgactcctgggtctaaaaaggacactgagtcctgctaaatcttaaacactgacagcagttaaagcatcatcttcagacctaggaggagatgacattcaaaataagctgcatttgtgagacatggagccagaaatgaaaactattcaacctctctaggcccagggactatcatggaagaggtgggcatatgagattgtaagggctgattctgagagattaaattagttcagagtttctctattaattaaacattaacatcaaaggcacactgatgcaagaccagcatctgggctcctgtgtcagattaacaaggttttcttgaagcattatcccaccctttaaaaaattataaaagtttagaaaatggtttatggaaattacatcttagggtcaagatgattaaaatttaatagatttgtttataagatttgagaaacaggatttaattggcctcatgctgtatttattagagcttattatttggaaaattaagtctcctctctcaaagaataaaggtttttaggccaggtgtggtggctcatgcctgtaatcccagcactttgggaagctgaagcgggtggatcacttgaggtcaggagttcaagaccagcctggccaacatggtgaaaccccgtttctactaaaaatacaaaaaaattggctgggtgtggtggcaggtgcctataatcccagctagtcgggagtctgaggcacaagaattgcttgaacctgggaggtggaggttgcagtgagccaagattgcaccactgcactccaacctgggcgacaaagtgagagtgtctcgaaaaaaaaaaagaataaaggtttttgccttttttctgaaatctctgagttatacctttggctaaatgaatgacttattttacaataacctgtgattctattttgtgatgtcaagtgttttaaactttctatatttgacaaactttccaaaataaaatagtcaattcagtccttttgacctcattaattttttggcattaggtcctctgaagtccaaaagagacatattcggcttatttggtaaaataaaatcatacaggaagcattgtcaaatatgaaatggtgtttaatcttctttggattatatttatataaatgagttgcttatataaatgagtatgtgttccaaaattgtatgagattcctgtgattctgatatgacttagtatacatcatcagtagtaattatgattattatgtaaaactattgaataccacagacgtaaccaaatttccttgtcaattgtgtctttaactatggctgttctaagacttttgtcatccacagttgttttagtttgatctttttataggtgatttataatcagctatagaactctgaggagtactcttaaacatgggcttctgacaaccttagagattgtgccattggaatagggagaaaaacttccaggactgtcatggagaactgatgtattcatgaggactgctaatcccatcttgagcagaacaggagttaattgcatgaactgaactaacaggagattgaaataatcttttatgagtttttgtttaaaacatttgttgattctttttgttttgttttacagagtcaagaaaactttctcttcttttaagctatttatagcttttaacaattcagtaaagtatactctcatgagaaaaatttaaaacagaatttctttctctttacctattttttccaaaacttggaaactatttgtgagtattcttaatttatggcaatgtagttatttgcctaagtatcttttttcttttataacagggcataattggagacactggttattttaccaaggctttaactggaatgacatattttcagactactttgagaaaataaggctgaactatagagctaataaaagcaccttggaaaaactggcttcatataccctgtcgtttacagggtcctgacctgtggaaagcaaagaatgtcactttttgaattcactcaattcatacaggtatctgcaggcacagctaaatccttggctgggtgtgaggcttttaaaaaggtctagactcagattccttatggaaaagcttccagcaaagccaattttaaaaagaagagagagctcatatggcaaatgatcagtcttgctgcattttatgaaaataatcaagccaagtataatataactaaaacttattttacaaataagttggtcctactatgattttgtctttaataaaattggggaattggagagagaaaagtcatgtttcaaaattaactatagtacacctgttattagagtctagacttgtctaatgtttttccatttttattattttccacaatttggactgaattctaaaaattctcctggctccaagtctccaaaagaatgttttcaatgttttcccttcttttttttttcctcccctcatttttcctgatgtgaaatcactaaaagttaagctgtgcttttcttaaagccctataaactgaacttaaactttggaagaaaataaaagcaatctctttatatgcagaaatcattttcatacctgcctactgatatacggacttgagagtaatatggcctctatcagttttccaggttcgttctttcttttttgtttatctgcttacttcctccttttttcctgttttctttctctcttattttctttgtgtgatgtgagacttcacaacctactaaaactgagctttcctaacaatgtgggacctattcgtctagaaataaaccatcctagacatgagagatcagacaaaacctgagaccggagattcattttcttctaaaatgctttctccaaaagatcttaaatagaaaaggggggcaggcatacatggtggttcatgcctgtaatcccagcactttgggaggctgagacaggaggatcacttgagcctaggagttcaagaccagcctgggaaacagagtgagaccccgtctctactaaaaattaaaaaaattagcccagcatggtagcacatgtctgtagtcccagctactagggaggctgagacaggaagatcgcttgagtctggaaggttgaggctgcagagcaaaaaacgtgcaggaagaaagaaaagaaaaaaaaaaagaagaaaagaaaagaaaaccagggagaaaagaaaaccggggagaaaggaaaataaaaactcaggacaccaattcactctgccatgaggaaaaaattaaactgaaagctgagtcatgcaagaagctgcctttcctactattcctaagcagatagctacagataaaagtttcagtatctccataggcagctactctatgttcaccttattttatgtaaagtgctgatttactgtgcatgagagaaatacatcattgactatcgccctacccgttccttttctcttgtgacatggggattaccataccttccctctttctcttacagcccacctttcccccgctttaagtattgaaaccctcaaagtcgtctttggagaaaggcacagacctctctactgggcatgtccttaaccttggaaaaagaaacatctaaattgattgagacctgtctcagacactttttggtttacaggtaccacttcacccaccaggatggccataataaaaacaaaaattttaaaaaaggaaaataaggctgggcatggtgtctcatgcctataatcccaacactctgggaggccaaagtgggaggatctcttgatcctaggagttcaagaccagcctgggcaacatggtgagaccctgtctctacaaaaaatacaaaaattagccaggtgtggtggtgtgcacctgtagtcccagctactcaggaggctgagtttgggggatcacttgagcctgggaggtggaagctataatgagctgtgactgtgccactggactacaacctaagcaagagaacgagaccctgttcccaccaccaaaaaagggaagaaaataagtgttagcaaggatgtggagaagtgagaaccctcatacattgctggtgggaatgtaaaatcgtgcagctgctttggaatgcagtctggcagttcctcaaaacgtcaagcatagacttactacaagacccagcaatgtaccctaaagaattgaaaacgttggatcttatacaaatgtatacactattattcgtaagcagtgtcagaggtgttcaaaccagagtgactccatgttgaataggagctgggtaaaatgaggctgagacttgctgggctgcaatcccaagaagaagttagacaatttttttttttttttttgagatggagttttgctcttattgcccaggctggagtgcaatggcgcgatctcagctcactgcaacctccgcctcccaggttcaagtgattctcctgcctcagcctcccaagtagctgggattacaggaatgaacaaccatgcccggctagttttgtatttttagtagagacaggatttcatcatgttggtcaggctggtctcgaactcctgatctcaggtgatccacctgcctccgcttcaccaagtgctgggattagaggcgtgaaccaccatgctgggccaggaagctaggcattcttaagcgcaggatgtttacgatcaagggaacacgttaaatcatgcttacccaacagacccaagacttaacagatccaggacttaacagacccaggaaacatcctgctgtcccgatattttatgaacaaaagccttcttagtttaagaataagttttgctttaaagataataatatagattcttatggaagattgttaggtaacaatcttttgtccccagcccttgtggtagaagagcacacctctcccatgatttttatcttctatataaacaagaagaattgtaactaaggcagacacattcctcctcttgccttcggaaacgccctggtctgtctatggtgtggccactctttcgttcctttaccttcttaataaacttgctttcacgttactctgtgaactcactctaaattatttcttgcctgagatccaagaaccctctcttggggtctggatcaggaccgctttcgggtgacagcagcattattcgtaatagctgaaaagtgaaaacaactcaagtgttcgttgagtgacgaacggataaacagaatgtggtgtatcaatgccacgaaacgttactcagccacaaaaaggaatgaagtactgattcatgctacgatgtgggtgaaccttaaaaacattaagcccagtgaaagaagccagacacaaaaggccacatattgtattaattcatttatatgaactgtccagaattgggaaatcaatagagatagaaagtacattagtggttgcccagggctggaggagggggaaatggggagtgactgctaatgggtacatggtttcttttaggggtgatgaaaatattctggaattagatgatggtgatgattgcacaacccggtggatatactagaaactattgaattatacacttttttttttttttttgagacggaatcttggtctgtcgccaaggctggagtgcaatggcgcgatcttggctcactgcaacctgcacctcccgggttcaagcaattctctgcctcagcctgccgagtagctgggattacaggcacccgccaccacgcccggccaattttttgtatttttagtagagatgggtttcaccatcttggccaggctggtcttgaactcctgaccttgtgatccatctgcctcagcctcccaaagtgctgggattacaggcgtgagccaccatgcccggccgaattatacactttaaaaggggagctggagggccgtggcatgatcatagttgactataacctcaaacgtttggactcacgcaatcctccagcctcagcctcccgagtagctggcactatatataggcacatgccatcacacctgactttgtttttctatttttttatagagacagggtcttgatgtgttgcctaggttgatcttaactcttgggctcaagcactccctgtctcagcctcccatagtgctgggattacaggcatgagccactatgcccagcccaaaagggtgaactaaatgggatatgaattatattccattaaagaaaaaagaaaacagggtggtgtgagacagtgaggggggctggtttacaaaaggtggtcaaggagggcctcctcaggagatgccacgtgagcaaagaccagaaggatgtgaagggagtgctctgggaggggcagggagaagagtgttacaggcagaggcaacagcaagtgcaaaggtactggggtgggagcatgctcggtgaggttttcgagacagcaggagccagcgtggctggagtggagaatgtggggacgagacgtaggcgatgatgctggagatgactttgtggaccacgagggccaaggccaaggtgggagtccggctcctatgccacgcgtggcagggatccactggagggtttgcagcaggagccagtaagtgatgtgaccacacctttaaagggtcataccagagaaagacaagaggaaggaaggagatgtgtcagggaactaccgtgacccccccaggagagcaatgtggtggaagcaatggccatggtccccggggagccagacctaacatctgagtctcccactttcagcacagggccttttgttccacacccagcagttcagggaagcagccacttctcttcctcctttccccctccctctctacctccctctgcccctgtctcctgctccctttttccctctacctggctgcccccagtataacccaaagggtgggacagctcgtgggcaggagcaaatggccagatttgagggccaaggctgggaaggatgggagcagaagcaaagatgaaatttgagggcctaggaagtgcctctcccaaccattccctcctctccccagcccatcccggcttctctagtcaaagaggagacttgcaaatttgagctctgtgagtctaaggaggtgcagggccttgccttgtgcctcatctttttgtgagcccctgggctaaggccacttctcctgaagtctccacgtgtcgtgctgcccaagtagccttggaataactggttcatggcagcccccttccagcccaggtcagagcctggcagactggacccagaagcagtgatttttgcataagaggcaggagggcatggtcacgatgagcccaaactttagcaccatacttcctggcttcaaatcccagccacgcttcttgctggctgtgtgacttagcttctccatgcctctatttcctcatctgtaaaatggaagcaataatgctactgactgcattgggctgtgccaaggatgaggggagttacagagcacctggcacctagtagctgggaagcagctgagaagcaggagcagtaagattcctgggcaccatttacctagtgccaactacacatcaggagctatacttggcattttccaaacgtttccttgtttggaaataatggctaacatttaatgaacgctgatggtgtgggagacaccacactgaggactttatcccagtgactcaatgaatcctccccctaaccttatgaggaagcaattattactgccaggcccattttacagaggaggaaactgaggtgcagagggctaagtcacatgccagagggtccaacatagaggacttgggtttctaatccagacaggtctggctgcagtgcccaccctcttgacactaccctggcccccagtcaccctaagtgggcattttcacctccattttgcagagatattccagagacctactcaaatgcaggccctgaaattttctcctaaaacatctttgcaggcgggagcaggctttcttcccctgcctttctcctggctgtggccggagctccccagcgagccaggtgttattcctggcagctttcctctttccccagaaaagtcccaaggaggcgcagacaaaggcaggaagcccggagcccaggcgcctgacccctgatgttggctcctccagccttgggccctcaatccaactcaggccgtggtcacattccagggtgactcagcctgcagccagcgggggcgaaggaggctctgttttggggactgtgggctctagccccacccacggacactctcacttttttttaggtactgccaggccctggcgggcagggcggtgggccctgacctttccatccccggctcctgcccacacagccggtttcctgcccaccctgggtcagatcccaaggcatcttttctgatttccgactggagccccatcacatgggttcctctaaaaacggcctattcctcactcactgacccctgtcgcctgccctggatctctctcccacttgaccctttgtgaaccagggaaaggagtcaaggatgggatgtcacccgcctccatgccccctgacgtatcgcatcttcactagatggaagagccatgaagggagggcgtgttgttcactccagcactcagaacagtggctggtctgaatgaatcatgtatgcagtcggtgctcaatgggcagcacctgcctcccagagttgctgagagggttaagaaagccaatgcaggttaagcacttgacacagagtccatcttctagattgtccagagcagaggctggcatggttcagctgtgcaatgttgggtagactgcccaacctctctgttcaatcatttcaactcaatgcagggccttaagctctgggaggatttaatggggaacaaaagggggcttagttgcacaggtgagctggagcaacccaaaattctgtttaacctgcttaacccattcttcccccagggctcacccacaggcctccagggttttcagtctgccattaacagggtttcccagatgctcttccatacctgccccgcactgctaccactgtgcataaaaagcacgtggccttgccctagtttttgttttctggtttttgaaatagacacaaattcacagaattatttctcaacacaggaaaaaacagcagaggaagtacagtggtaactagaatagctgcatgctggagaggcaatagggagtagtggggactgtggcaagatttagagagggtgctaccactgagtcccaggaaagtattgctagatcttcccatttttcagaagaagttggaaatctagatttttgtgtatggaatcccccaattttctccccatgtcccacacagcacaaacccagcccatccagggctgaatccagtcacggaccactgttgggtgacctctggtcagtgcatgttagaatgagacagatttatttgtgcctacaaattctgcatcctgcaagggcccagaccagccactgggccacagtgaccctcgcttgatgccactatgccttccggacccccagaaaaggagcctcccaaccaagagatctctctcagtgctccctgtggtggtcacacaagcccaaaggaagagatgcagtagcctggtgatatggctggggcttgagagaccacctccatgagccacctcgaagtacagataaactgaggcctgggaagcaggaagaatgcttctgatactcacaaggcaaatcaattagtttcaaggggcccacaagccatactcctaactctcagctcaccaccctcatgttcaccgaatggggctcgaaaattcttgctgtaattgcagaaatttgaatttgaactgggaactacatgacattaagaattatctttttatattctcaggcaagaaaatagaattgtagttgtcagttttatatgcattctgaaatattcaagggtggaatatcatgacatctaattttttttttttgagatggagtctcgctctgttgcccaggctggagtgcaatggcgcaagctccgctcactgcaagctccgcctcctgggttcacgccattctcctgcctcagcctcctgagtagctgggactacaggtgcctgccaccacgcctggctaattttctgtatttttagtagagacggggtttcatcgtgttagccaggatggtctcgatctcctgacctcttgatcggcccgcctcagcctcccaaagtgctggaattataggtgtgagccaccgtgcccagcctatgtctaatattttttaaataatgttaatgactgtcaaatcaaggtataggtacatggggcttcttaccgtattctttttctttttctgtatagttgaaatgtttcctaatttaaaagttttaaattaaattctaaaggtaaagacggagttgctcactcccagaagtagtggtgtcttactgggataagcatgaattttggaggggcctagatgtggagtataatttttgtatgaccttgggaaagtcacttcatctttttaaacctcagctgtatgataagggtgatggaaattacctcaaggcttggtcaggataaagaaatgagacaagggagctggagagccttgcttattttaacccaaactggatcaccattcagacggcatcagggtcacccacttgtttcacttgtttgcccttttttttttttttttttgagatggagtcgctctgtcgcccaggctggagtgcagtggcaggatctcagctcactgcaacctccatctcccggcttcatgccattctcctgcctcagtctcctgagtagctgagactacaggcgcctgccaccacgcccggctaattttttttgtattttttttttttttagtagcgatgaggtttcaccgtgttagccagaatggtctcgatctcctgacctcgtgatccgccctcccggccattgtccttctttaagaattttttgcttgtagttgcatttcttagtatctaaaagtcacatggttctaagacttttgagtgttcagattaccagtataatgtgtgggaagactgagaattcattcttcctgtgaattaaaaattcttgcaaagccaggcgtggtggttcacaccggtaattccagcactttgggaggctgcggtgggaggatcgcttgagctgagtttgagaccatcctggacaacatggcaagatgccatctctacaaaatttttaaaattaactgggcatggtggcacacacctgtagtcccacctactcaggaggctaagatgagaggatcacctgagcccaggagttcaaggctccagtaagctataattgtacactgcactccagcctgggccacagtgtgagatcctatcactaaaagtaaaagctaaaaattcttacagcccagagttttaatccagacagaccttgagcaagttgcttagcctttctgagcctgtttcctcctctgtaaaatggagataaccagagtgtccctagctgaactggaaggagaaagtgagattggggatctaaactggggtccccagggtccatgcacctaccctcaagctgccagtgaccctcattcccacacttctccccactacccactgttgacccttccaaggtgcccacaggtataaaaatcaaaggctcagcagggcgcggtgactcacgcctgtaatctcagcaccttgggaggccgaggcaggcagatcacctgaggtcaggagttcgagaccagcctggccaacatggagaaatcctgtctctactaaaaatacaaaaattagctgggcatggtggcacatgcctgtaatcccagctactggggaggctgaggcaggagaatcacttgaacccaggaggcagaggttgcggtgagccgagatcgtgccattgcactccagcctgggcaacaagagggaagatccatctcaaacaaacaaacaaacaaaaaaagagcccataacgtattcacatgatggaagactccagagaggatcaaaagaatggattcgatctccttgtagcaaaaagatctgcttgtagcaaaaagaacagatgtcaaaactaaaatctggagtgaaaagagcaagcaacataatgtctgaaaacatttctatacagtgtattgagaaagcctgacaggaaaaataattcatttcttccctgagacatttattcactgtctttttcttttcttgttttaaggcaaatgattgactacacagttgtaaatttcagctgaaaagatgtctggaggttgaagaaaaatacagtgagcttattgtttgaaaattcaactaccatattgtttaaaaatcaaaaagttcccaaggtttccggaattttcagacacgaatgtaaactaactctctcttacgtggctctgtattagctacaagctcatgtctatgtatgtaagagtaatttttatgtaagagtaatttttaaaacatctgggagactgaggaggtatgaaaactaaaggcaatgtggtaacttggggccggatcctggaacaaaagaggacagtaatgggaaactggataaaatcccgtgaagtttgaagtttagttaagagtaacggaccagtgttggtttttagtggcgacaaatgtcccataacaatgtaagatgttaacaatagggaaaacggggtgagagaaatacaggaactttttgtactatctttgcaactttctgtaaatcccaaactagtctcaaataaaaagtatatttttttaaatatggaaggttctacccagactcagcaacaggagaggcccagagagggagagaggactagacttcaggggctgggggagggttaaggggcttcggtcttacctataacaggataaatatttgtgttaagtcgaatgtattcagctattccttatgcaattcaagttaacttaaaaaatattttatgaaaaggagagctacagctatctccttgatttgaggctgtctttactttttctcctaaatcacagatgctcaatggagctggaaaacctttgggaccaggaggctgtgacatctgaccctggctccgttctgtccaggctgtgggacctcaggggaaggtagagacttcataggcctcagtttctccctggcaaatgaaattactaagcccaccgacccccgtcttccagacggggaatcccggggtgggtggttccagggcatgatcaagacatcccccaggggctctacactccgctggctcaacactcccatctgtgtaatgggttgaggagcgaggctatccctataggactgccgaaagcaaggcagggtttgacagcgcgtaggtgggtgccaggtgcaggcagaggctggagagtggagagcgcttcttccacccgggccacgcagaggctgtccccgcacggctccccacccacaaaccctcggtcctcacctgaaaccccctcctaggtccctgccgtcgcgctaagggccagactcggacttgtcgcggtgggcgattcgccccgggggacctaccggaccccgcaccttcccaccttgcaccttcttggcagggggagcacggcctggccccctcacccacgtgcggggccccgggactcccacctccgagggtctcgccttgcccgggatactggagcgggactcgggccgggccggccgcgggctccgagacccttgggctgcagcccgggcgggagccgccccctttgtctggcggggccgagcggagcaggacactcaccgcgtgcggcggcggctcagtagcagcagcagcaacagtgcggccaggaggccgaggagcgcggcccaagccatcgcggggctggcggggctggcggggctggcggggctggcggcctggcccactcccaggtaaagttccccgcccccacccggcgcgcccctcccactccgcccaccccagcccgctttggggcggggtggggggggtgggggatggggccctccgaggtccgcaggggtcggaccggggcgctctgttagaaaccctgctccccccagctcaggcctgatggaaaatgtgggagggaggggaggggagaaggagggggagggggagggggcggaagggatgtggtgggctggggagtgatcaaggggaaaggagatagatgggggactgagggggatgtggtggactggggggtgatggaagggaggggagagggagaggatttacaggaaggaagagattatatgcggggagggaagagggatggggaagatgggagaggacttttggggaagggaagaggagggaatgtgggaagacggcgggacgatggggaaacagccaaggaggtatggggaggagggggcacagtgggaggagaaaatgtggtgggaggggacgaacatggaggaggagtgtaagggggtcaggaggagctttcccaccacattccacattccacctagacagaggaaaccccccaaggctcctcctcaccccatcccccaccccaggcgtgctggggacctggagttttccattctgtggtctgggctgggagggctggtctggattatatcgcaccctatagtatcttcagtaactactgggcagggggtacaagggtgtctcagggagtcccctcatcctcacctgctttggggacagatagtgcccgtgaagtatgcaccctctacctggtgcacgttagggcctccggatgtggtggccattgtcatcgctacctggtgcttggggtgccagccccctgtgcccgcggctctgcaatgtaccaccccagggtgctgatgagaactgggggtcaatccagcctcactccacgcccctgcccccaccatccccattcccaccctgggaagcgttgggcaggtagctcaacctctctgagctcacctcattatctggaaacagggagggcagagttgtgcttacctctggggctgttgtgaggaagtgatgagagcttgacactaaaaggaatcacaaactgttgagtgcttggcacactaagttttatgaaaccatgggctgaacctggaggtaagacccaggaggtcttgttctagtcctgtatccacccattcagtgccgggtgagcttaggcacgtttcattccatagtcccagcagagctctggagaagctgttgctcctcctggtctcctggcttccatccttatcagccagggtcctgacaaggcccttcgagaaccagcatgatccgccccttctcacctttacctgcctgaccctatgcccccgactctctccctcacccactctgctccagccacactgatctccccatctttccctagaggtcccactgcagggcctttgcacgtgctgttccctctgttcggagcattcttcgcacagcctgctctttccaccacctccccggtgcctctatctctgctcagctgtcactgcagagaagctgtctttggccacctggtctaaaacagtcatctcctcttactgatttttgtttctttgtttttttgatagtttttttttctggcagtacttcacatgtcctgctatcatactcaagattcattcatttgcctgcttaatgttggctgtcgaggcagctggatgacccccttgtggcctcagcagattcagaacagcaggaggcaaaaggagttttctgatcctcttgtttatttttccagcttatctgccagagaagccaacaatcccaagaaggccatagaacgggtccagaggattttctccaaatttggggagctccaaagggctgtctgctagcagtggggttcacagctgggcttggccgatcctcagctttgtgaccccaagcagactgctccacctccctaagctgaggttcctcattgacagaatggggaaaagagaacctcatggagttgaggtcaggaacaaacgacctggtccatggggcacacctatgtgagtgcctgtcacaccatgagcatcagggaaagttaaccgcaattagcgcttataccagttccgctcctctccattatctgtgatcaggcttggtctcaattttcccatctgaaaaatgggaagaacagttccttcctcatggggctgctttgagaactgaattaaatgaaaagagaatgaaatcacccagcacagggtctggtatacaataggtactcaataaatattagttcttctactccccacccctggcttcagtgcagaccaatatcacctcaatacaaatatctcttccagatactctcttcccttctcgacccatagacaaaatcctcccagggaaggagaggcagctgctcacacaccaaagggagatgaatgtgagcctctggttcttcctggatttgttcaggagtcggcatatgtttaggaaggtggccaggcccccttcccagagaatgacccaccatgggtctgagctggtccaggaaatccacctttgctagtgatttgtcctgaggtgggcaccttccagatatctgttgcgggcttctagaaaaatgtgtttccttcctatttgccttctcttctgctttgggggcaatcgtgtgggaatgtgattagtgggggagctgaggggggctgtagtgttatgagggaaggccaagaaaactgcagagccccaaaccagagctgcggaatcaccatccctggaaccacctgcctatagatttctcatttaatgagctaaccacacgtctgtgctaggacaccatgagtcagatttttctaatacttgcagccaaagacattcccaactgagacgccttctagatatggctgaagggaggaccaaatgaggcaatgatgcatccggagcacctctgcaggactggcccatgcgagaattcaaaagtgttgctttgttttattatttttactttgcttactgtgtaagctttctatgtttatcaggctgacaggacatccaaccctctggctatggcatcttggaggaacaggcaggccttgaaaatagcagaaattccgaattcccctgccccgggaggactcaaaggaccctgctgaggacagagctgatatggcctcagaataaagatgagggaagaccatcccaaggaagacccctctagcccatggcaaaagggctggaatacgcaaggatttgaaaagcaagttttgctttccatataaacctaagcaagtcgcttaatctgtgagcctcaactactttacttgtgcaatgggcatgttgctggtagtggtgatagcagggagccaccgagagagcttccaagtgtgccatctaagccctcctctggggaagggaagctcctctggggaagggaaactggacccccgggaaaatttattctcccagggacgaacatccagacatttccctgtaggagcctcagtgtgttcagatgttcactgtccagtagaaacaagacatctaggcaactctcccatctcaccaagcctctgctctcttctgtggccactgtggggttgtgagagtaatgtcaagacccaacccaattagaacacagggaattttgcctgggaaagggagcccttctaccctacacccctgctttctctcttccaaggatcaggtctgattcatgtctgcatcctaaaggctacaaataaactgtgtccggaaaggaaaatattatgtgtattgccttcttcaaggctaaaaaccagtctcaacagagaggggcagttttaaatatttttttgtaacaatagttctaactttagttagtaactgaagccatctgaaacactttttcataataatttatttattccccacaaagaacctataaaatgggtagtaaaattattccgaattcacagatggtgaaatcaaggtccagaaagagtcacttcacccaaggtcacgtagtacttcctttgataagctagagcatgggaatttgatggcttcttaggacaagctaacttactccctggtgctgcaaacacaccctgggccttcccacctccacacctttgctcatgctgtttacctgcctggaagccctctctttctctaccttttgatttttccaaatcggttaggagcaggttctccaggagagccaagatgagatgagatatactaaaggcttattgagggagtgccagggagtaaaatgaagagggagccagagagggctgggagaaagggacagaaaggaggacaaatggaaggaagggacagaggaaagaagggaccgtgggctgcagtgcattcttagaaaggtcaagtctggccgggcacagtggctcatgtctgtaatcccagcactttgggaggctgaggtgggtggatcagttgaggtcagaagttcaagaccagcctgggcaacaaggtgaaaaccccgtctctattaaaaatacaaaaaattagccaggagtggtggctggcacctataatcccagctacttgggaggctgaggcaggagaattgcttgaacctaggaggcagagattagagtgagccgagaccgcaccactgcactccagcctgggtgacagagcgactctgtcaaaaagaaaaaagaaagaaagaaaaagaaagtaagtaagttagttcaaggctaacaggttgtccttgagcctcctgaggagccctatgtctcccaagaacaagtctgcttcccccagtgattggctaggagcaaaccctgggaagcatggcatatctgtcaatcaggctccaccaagggaggtcccagaggtgtgttttcatggctgctgcagctacgaaaggaagcacagctgccgtctaaaactggaacaatgcaagaataaattcttccacttacagaagctaaacgaggttgagaggtggaggggaaggagagacccaaaccgcaacgtttctggtgtttttgtgctgctaaagagagagtggtaaactcaagtcttcgagcaagtattgcaaatgaatgaagtgagccagtcatatcaggaaggcaacagggagggatgggaacaatggaaaactagagagggctgccccatccaaaaggaagcagcttctggcagtaccagccaactaaagccacgtagaaatacatgcctagtgtggccagatctttagactcaagagaagccagaaataatggctccaattattttaaaacgctgcatagaccaacagcacacacctgcccccagatttttagccctgcagtctagttgtgccaagggccagtggtttaaacatttggggtatgtaaaataggtttggagttgggatgttgaacaaaattgctctgtagaattaaggaaggacaacagagttttagggggcagcctgaaagagggggcaaagaccaggccgacatgagcacagattgggggcctgtcccagtgtgacatcctctgtggaattaggagccaataaatgaccatttctattggtgatgtgtcatactgagtgtttagttgtttgctgtcttgggctgtggaataacaccacacatacactcatatacatacacacgcacacacacacatgcactactctcacatacacactcacatgttgccccagttacccccaaacgttcagaaacaatctgctacacacgtcaagtgaccaacgcatcctggtttgcccagactttcccagttttagcactgagagccctgcatcctgggaaacctctcggtcctgggtaaaccaggaaggttggtcacgctatcaccacacctcagcgtagcgtgtgagtggccagagattgggtcagagctgtggcagccaccttggagcctgaggagaatctttgctaagtcacacaattaattagccacccctggaactgtgctgcagtagattagatcatagtctccaatttttacccactccctgtatcagaattagacattcacgcccttggctgcagggttgcggtgcctcccactatgagcagagaatagtatctccctgactcagtgatggtggactcgggcctgtgactcaatttgatcagtggaggatgaagaaatgaccagttgccagttctgagcagaggtttcacgaggaatcacatatttccacttgaccttggtttctgccttgagccatgacccacagggcaaacctgagctcaacctgcagcctgaagtagagaacccctagctgacctgcagaggtccgaagaagaaaaatgtacgtgttgttacaagtcatggagattttgagatcttcttaagcaacaagaattgactaatgtatactttatctctgaactttttagaatccttttggttgaatgttctttgtaccagttaaattagaataggctgctttctactcttggagccttggtacatctgtacaagaggatgatgacgacaaggcccccctcccatggtggttggacgaattcaagaagatcttgtgtctagtgcatgcagtaggcacttaataaaagagatgatgctaggccggctgcagtggctcacgcctgtaatcccaacactttgggaggctgaggcaggaggatcatgaggtcaggagttcgagaccagcctggttaacatggtgaaaccccgtctctactaaaaaatacaaaaattagctgggtgtagtaggggacacctgtaatcccagctactcaggaggctgaggccggaaaatcatgtgaaaccagaagggcgggggttgatcgcgccactgcacttcagcctgggcaaaagagtgaaactctgtctcaaaaaaaaaaaaaaaagaaaagaaagagagatgaagcaaggctgggctcagtggctcacgcctgtaatcccagcactttgggaggctgagatgggtggatcacttgaggtcaggagttcaagaccagcctggccaacgtggtgaaaccccgtctctactaaaaatacaaaaattagccaggaatgctggcgtgcgcctgtaattccagctactcaggaggctgaggtgggaggattgcttgaacccgggaggtagaggttgcagtgagccgagattgtgccactgcactccagcctgggcgacggagtgagaccctgtcttagcaacaacaacaacacagcagcagcagcaacagcaacaacaacaaaagagatgaagcataattctttcagcacatattaccaagtatttatttgccaacactgtgcaggcctctttatcaagaattttactgaagaaatgaaagacagaaaacctcttcacttggtcttttttatacatgaagagaaagcaggtctgaatcagaggcagagggttggaagaaatgacctgttttctgccatctgggccttgctgctgactgtctctaagaatttgcacaggcctgggcctttggagatttgaaggtctctaaagtgcaaggatgtcagctgcaggggagccatcctccagcatccttccccaggagagccaggattatgtagggaatgtgcttggctaagagcccagaggtggggcagctacccagatgcaaacatggctgggccaggcggcctttcgttcagcgttcccaggctaattccacctagaccttgtcttagcctgtgagaggatgttctggagtggtcttgcccctcttcccaggctatctgccagaggtggtgggtgctacaggagagggactccagcaagcttctcatcctttggttttcccaggacgggggacaggtggcctcacggctcccaaccagctgccttggcactttgtagtggaaaaaatgatgaagtcagacctcagtctcctcaactccctgctgtcctgcctgagagccagcctagcatggaaggcaaggagaaaagagacccatgttgatctgtcacccagacagaccctgagtgatgatgctcctgccaccctgaagcaccccaagaacctcagaacttctggcttctcatcttgaaaatgggacagcagtcatagctgctttgcttattatgtcaaggagttactaaagaggatccagttagatagtgggggtagaaaaatggctgcctaaggccacatttaccctctccttctagaaattataccagagcatcaagaataatggaaaaacaaatatacaaaaccaaaccacaaactccatttttagcaaagccaggagagacatataattcatcggcttcagagtacgtgtgaagcagctaagacagggcagaagccacatgggagtggtgagtgggctcagtgatagcaaatctcagaaagcatcagcaaaactacacttcctagggatgagggcttgccatgagatgaaagttatgttccttctttataaaaatgaatgtagaagcttgggtgaatacgattagcagcagaagctctcctggatctcgtttggttcagagaaacagaggaggtatagtgaagaattacagagagaagacatatttgcaggaagcagtctgtctctatggcagcagaggagagccacagttacagagcccatgaagctaccctaattcttccttacacccataggagcaatcagcaaaatacctgacccaggaaaaccaagcccttccaatgacaagcttttgaaaaagtgtaaaagccttgatacaaagatattatgataaattatgaagagcagaaaaatctaccaatagatgaaagtgttaacacaaaatggatgaaaattatatccaaatcatattggcataaattcaaaaaagaattgaatggaggctgggtgtggtggctcacgcctgtaatcccagcactttgggaggccgaggcaggtggatcacctgaggtcaggagttcaaggccagcctggtcaacatgatactctcgaggctgaggcaggagatcgcttgaatgtgggaggcagaggttgcagtgagctgagatcatgacattgcactccagcctgggcaactagtgaaactccgtctcaaatttaaagaaagaaagaaagaaacatcttaggagaactgaatggagcaactacctctgtgaaggaggacaataaggaaactgaagaactcaaaaagaaggcaggcaaaaggaggtaatgaacatgaagggttagcactcaggaaagaagtagaaagaaaaaaaaatatcagaaatgaagacaaaattggaggggaaggaaataggccctgcagaaaatacagcaaggacacggttaacagaaatggaaaaagaggaaaaaaatgagacagaaataaagaaaacattagaaagactagaaagaaaattggctgggtgctgtggctcatgcctgtaatcccagcactttgggaggccaaggcaggcagatcacttgaagtcaggagttcaagaccaccctggccaacatagcaaaaccccatctctattaaaagtacaaaaattagccgggcatggtggcacacacctgtaatcccagctactcgggaggctgaggcacgagaatcacttgaaccccagagacagaagttgcagtgacctgagattgagccactgcactctagcctgggcgacagagcaaaactctgtctcaaaaaataaataaataaataaaaataaataaaggtgtgagcatccatgcaccagataacacagcaacagatagttacagagcaaggacattttaagtcacttctctcagctcttgaaataccaagggaaaaaaaaaaggaaatagaaagtcaaaataacatagtgaaccacaaacactggctacctagtaagccacaaagaacatggcaataatttttttaaaagcagaataaaagtacaatagtctcagatcgcaatgcaacaagcctgtgtgacctccattcctctccctcccaccccagcacctccccagagggcaataatcccccagccccacttcaccaggcatcagctcctgtgtctgttccatgttagatcatgttagatctcatcttggccagacacggtggctcacgcctgtaatcccagcactttcagaggccgaggcaggtggatcacctgaggtcaggagttcaagaccagcctggcctacatggtgaaaccccatctctactaaaagtacaaaaattagctgagcattgtggcaggcacctgtaatcccagctacttgggaggctgaggcaggagaatcgcttgaactgggaggcggaggttgtgagctaagatcgcgccactgaactccagcctgggcaacagagtgagatgctgtctaaaaaaaaatctcatctcaaacacacaaacatttcactgctttaaaaaaaaaaaaatagaaatctttggtggatgttcagccacgctcatggttcacagctccaaactctgatgcacaggcaatcacatagcccaaatgtctacatgtcctgcatgtccgcagagggctagagtgagagagcctgggctccacggccagactatgtgaactcaaagcctggcacccgcccccccacttaaaaggcctcaggcatattgcttatctgtgcctttgtttccccaggtgtcaaatggagttggttgtgaggatgaaaagagttaatctctggaagtatggaaagccttggataaatgtgggctattagcattattttcacagcctcccaacctccctccactaataccagacacgctggagagagttctctgtctccctaaccatttatttggtgatcagaaggaccttctgcctgtgatttctgacctggcaggatactgggggaccacttttgcctctgcctggagatagcatgtctgagaatgaaaccgacttacagggcagcagaaccaagagatagggaaatacagtttcttgagatatcatttgaacccccggattcagccatgcctgaagccagaatgctcctgaccacatgaaccattaaattatttttgtttgcttgtttcagccaatttgggttgagtttctttcacttgcaatagaagaaagttctccattctgaagctgaataaggtagtatgtgaagtacttgtttcatacctggtgcttaatggatgaaaccttattacattctcatttcgtaaaccttctccagggctttctgggaggcaaccagatatgaattagagtgacacagctttgcactccttgcccagcctggataagatgccccattcgcagcaagctctatgcagtcagggccagcttcatggacatgcaacctgggtgctcacataggcccctgcacccagaatggtctcatgctcggcttagcgctctcctgtcaccagcttgaaattcttaattatttttgaacaagggtccccatgattttactttactctggtacccacaaagtatatagctggtcttaataccagtatcatctccactttccaggtgaggaaactgaagctcaaagaggggaagcaagcagcccaaggtcacacagcaagaaaggggtggagctgggaatcaaattctgattctgaggcccaagttcataactgcgatgtgccagtgcctggacaattcctcatatgtggatggcacttcacagtttatactctagtgcatagcatttgaccctcataccagctttagaagcagaaattgtcatgctggcatcaggcagagtacttgggtttgttcaagcctcagaaaccaaccctggctaatttaagaaaaagaaaaggtggggacgaggtattggaaggaaaagttgaccagctgggacttggaaaggacaggaacaagcagctccgggaacgcggggagcaggagccaggggtgtggggagcaggaaccagtggccaggtcttcggggctccagctgtttccaatctcagcattccttccgcttcagtttctgattctcccacgagaaagtctgattggccatgtttgggtcatgtgcctgcccacagaccttgatggtcaaccaaacaaggtgggaaggatgatcccccaaaggcgggtcagaaagtggggtgggagggctgaaagctgggcagggacggctgtgtgcgcattttacagatgaggaatgggaagcccagacagaaggcaaggccacagaaccgggaatggtggagtctgggctccagtcagaggcccaggctgcctctcttcactcccaggactccaggctggcaggggaacaggagggcattgttctccctgttggagtgaatggccgcctcctgggaaacccaggacccagatggggtctccccagggcgcaggaaactgcctcagactgagctgtattcaggggtcgaagcctcctccccaccctccccctacagtggacagactcccccttcaaatccaacctcactgctcagctctagccctatggtttttaagagaagctagtgggggaaaggcttatttttccaatgtgcattttttccggtatgtaagatactgtgtggaccaaataaaatatgtccagacctggaaacagcccaagcatagctagtttataagtcctggaatgctccttcctgcacacaaaaattaagggtctgtttacatagatatgctagtgtgttggagttgaacttttccttactctgaactcagatatgcaaagaaaaatgagccttttacattttccatggatgtcatctagttcagtgattaggagcaagagacatgctggagccagagaacctgggtttacatcttggctttgccactatgtgacctcaggcaggtcacttaacttctctgagtctcagtttcctttaagggacatatgtacacacgggtgtggcatttaataaaaaccacaaaagtccctgctactgctctgtgtccatggtatgatgttggtcatgagccctcacactggaagaaatacaaaatcttaagccaggctaatcatttaaactgtctatttaggcaagacaggcttcccctggggtatttcagggacaaactccattgatcagtttcccaccttcctctgctcctcttcaagaagcttctgcctgaacaccactttggtaacagggaaactgagctccgaggagagaggtcaaggttaggaaatgtcatttagtgagtgtcccttctgcacaaagccgtataggtacgcaagctccttgaatcctcataaccattctggatggaaagaatcaggactcccttaaccaacattgtggagcttgcaagtaacggaggcagcattagattccaggatgttcaacttcgaggcctgccttttctctgctcctattaactgtgtattcccattcctggtcataaggcaagattcagaggcatctgtgctccaattgaccatggcgcttgatcccaaaaggaaaaactctttctctctctctctacctgattaacaataataataacaataatttaatggctcaagcagggaaagtccagtggtgggaaatcctggcttcagggaactgggaagaaaaacagcttcaggaatggcaggatccaggggctccatggatgttgccaggactcacttctctctctaagcaatgctttcctttgtattggcttctccctcaggcagcctctccctgttttgtatcaagatagccttagcagtccttatgccctggcagcttggtgatgccagcagaaggagactctgggactaactctggttggccttattaaggtcagatgcaaatccctttacttctttctctagctcatatcggtcaggcctgcgtcgccttcccacttctagatctggaggtagagactagggtagttttctcacattgatgccctaattaatgaccttcctgcatccgagccctttgcagtgtgagtttatttccacatgatctgaatctgggcttggccttgagacttgctctgaccactggaatccaagggaagtgatgctgtgcctgcttccaacctaggcttcaagagtcttcttcacttctcccctctctgttggaactctggatagccaccatgagaacaaacctgggctagccagctgcaggaggagaaaccatcttaagaagtgcctggtcccccagcaaagactaacagcgcaacagccagctgacctatcagagtttgttttttaagcaatcttatctaccttcttgcaggactaggattgacagatgacaaaaaaaaaaaaaaaaaaagagttaaggcacatctgtaaagctagaaattggaaggctgctagggtttgaatcctggcatggccattccctagctattaggcttagtttcctgtggctgttataacaaattgccacaaactcgatggctcaaaacaacagaagtttattctcacacagttctggaggccagagggtgagcatcagtttcactcagctgaagtcaaggtgtcagcagggccatgctcccacagaggctctgggggacaaatcactccatacctcttccagctgctggtggctgccagcattcctttgcttgtagccacatcactgccatctctgccttggtcttcacgttgtcttcttttctgtgtgtctgtccaccctcccttggtcttcctcttacgaagcatatgacatgcatgcttttaatacatgtgataacatttagagcccagcaagataatcccagataatatcctcatcacaaaatccttaatttgatcatatttgcaaagactttaccatataaggtaacattcacaggctcctgggattaggagaacctgatttcttagaggtccaccattcagcccactgtactagcatgtggctccaagtgagtgtcaacctcactgtgcctcagtttccttatctgtaaaatgacagcagccacctcactgggtaattatgaagatttaataagtacttagaatggtgaccagcacatgataaaagctttgtaaatgttaaccttcaataatatcaagggtcggtcgggcgcggtggctcacacctgtaattctagcactttgggaggcagaggcgggaagatcgcttgagcccaggaatttgagaccagcctgggcaacatgacaaaacccagtctctacaaaaacaaaaacaaaaacaaaaaacctagccaggcgtggtggcatgtgcctgtagtcccagctacttgagggggctgaggcacaagaatctcttgaaccctggaggttgaggctgcagtgagctgagtttgcaccactgcattccagcctggggggcagagagagactctgtctctaaaaaaataataataataagatttgactgtgactgaaattcgcacaagaacaaatcccttctctgtcctgtttgctcgcgcctgtcttcatagcacccaccatggagacttgcacatagtaggtgctcagtaaatattaaatgcacacatgccactatgtagctgtgtggcttcaagcaagttgtttctcctctctggtcctcagtttccttctcccttcacgaagagcttcttgtagggaaagtccattcctctttctgggagggtgtgtccccatcaggggtagagggttcaggggtcaggagccggccacagctgctatctccctgagtcaccaaatttctcaacttgaggccaagtgtctaaatattgtgactgagccagttagagataagatgtggaaacattgatttggcccaagcaactgcagtcacggtgctggagccagacctccctggatcttctcagcagcatgagtgagtgtttagcacctgccaggaacacaggctgctgacctgcaaacagatggggaggcccagatgcctggcttggcagcaagagcctgcctttgccgtctctgtttacacagccagcatccagtcaaatctctgtggctccagtggagaaactaaggcccaaagggagtgaaggatgtgtcgtccagggttacgctgggagactgctatcccatgaagctaaaacccgcaagtcctaactcccagcccagcacctgtgggaacccaccaggcccagggagaaggaaggctggcagcgtgtcacaggcagggagcgtgcctgagcaaatgctcaggggtgaaagaccagatgcaagctcaaacactagagtgaatgggagaaaaggccacgtgtccaggactttggactcaattcagagaataaaagggaaccatcgatggttttaggaagaagagcagcaggatctgagaggctttttccaagtgcttatagaccaccagcatcagaatcgcctacgacaggagctgggggaggttgtcaaaatgtgggttcctggggtccaccctagatgtggctccccattgtagcaggccccctctgaggggattctgaagcacacccactgttttagtgagtaggagatgcagctaacatcccacttataaggtctaatctcagacaaacctggtttcaaatcccagctctgccacttacttgctctgtgattttaggtcacttacgacacctctctgagcctgttttctctcctccgtaatgaaacaatcttagcatttgcctcaaaggtttgttctaaggattcaataagataatgtaggtaaagtgctctacatagatccagagccctcctagtgctcaaaaacactggtttttagagattcccttgggcagcagtggggagaaagcaatggaggagggcaggcaaggaggcagggaagccagtgaggaggcagcagtgggactccggggagaggtctgtggctagggtgtggacatggtgacgggtggggtggctcctttgcaccgtgccaggtggtgccgatcttgtatgctcgattgcgaaagaagctctctggagttggtctagggcaggagagaagaggatgagcaaaaaaaccaaaagaggttgatcataaaacccatattcgcagtcacggactgggtgcttagcgtgggccaggccccgtgttagctgcttcctgatcttcatcctcacaaccacctgacagtgtgggtagcacttcatcaggggttgttaaccccgacactagtgacacttgtactggataattccttaattaaggggctgtgctgtgcactgtcaaatatttaacaacacccctggactctacccactagatgccattaacactcccaccttccagttatgacaaccaaaactgtctccagacattaccagaggtttcccgggaggcaaaatcacccctagttaagaaccagtgctttattctccttttacaaggagggaattgaaggctcagagagccaaagccctttgcccacagtctcccagctaagaagtggccggatttgaactcaggtctgactcggagccccggatgttaacctttgccgtgaaggaggccacatctatgcagtggcaggcccagatggtctatatgggggtcttggggacagtggtcttttccgaaggggcagctggaaacacctgctaagcagatgggctgcgtgagcgtttgttgggggtggttgtagaagcgatgatggggattatgagagagccaaatccccctccagaggctaccaccatttgccctggacagagggactgagggagatgggacgtggagggcaggcaagaaggaccaaggtggcactgttaggagaagctgggtgaggtcatctatgcctggagccccactgccgggagcctcccaaaaacactctccaagacctttgggctaaatatttatcctgtgaatgctcttttccttcctgcatggggagtggggctttggaggtgggtccaagaaatttggggagacagaatccagagaaagaggaaggggacaggccagaggtcagaggtcaggagaaagtagtcagaggccaggaataaacattcatcctggcatctaaagccttccagagtgagctccactgccaccacagccatctcactcagggaggcgtagaattcaaaatatgtttttgttttcttaagagacatggggaataaaattacaattttttttttggtccagtctttttttttttttcttttttgagacagagtctcactctgttgcctaagatggagtgcagtggcgcgatctcagctcactgcaacctccgcctcctgggttcaagcaattcttgtgcctcggtctcctcagtagctgggattacagccacccaccaccatgcctggctaatttttgtatttttagtagagacaagatttcatcatgttggccaggctggtctttaactcctgacctcgaatgatctgcccacctcggtctcccaaagtgctgggattacaggcatgaaccaccatgcccggctcagtcttgatatttttaagcaagggagttggaggtgaagggaaaattaagtcaaaaaatcttacccagaggacaggtgtggtagctcacacctataatcccagcactttgggaggccaaggcgggcagattgccagaggtcaggtgttcgagaccagcctggccgacatagtgaaaccccatcactactaaaaatataaaaattagccgggtgtggtggcgggtatctgtaatcccagctactcaggaggctgaggcaggagaattgcttgaacccgggaggtggaggctgcagtgagccgagattgagccactgtactccagcctgggtgacagagcgagactctgtttaaaaaaaaaaaaaggctgggcgcagtggctcatgcctgtaatcccagcactttgggagcctgaggagggcggatcaggagtttgagaccagcctggacaacatggtgaaaacttctctctactaaaaatacaaaactaggcggatgtagtggcgcacacctgtagtcccggctactcaggaggctgagacaggagaatcgcttgaacctgggaggcagaggctgcagtgagtcaagattgcaccactgcactccagcctgggcaacaagagcaaaactctgtttcaaaaaaaaaaaatcttatccagagaagaagtcatttttttagacacaagaatactttgtttatacagatggttgctataaaaggcctgactttgtgccgatagagaagatggatttatggtgaaggcagctcctgaatgagctcagtaatcaaagtcaaggtcctgccaggttaagctgcagcaggctccgctccctaccaaaaatgacaggctctgctccatctgatgggttctgctccagatgatggaactcataagggcatcatgctgtcaaacggttttactgccaagactgttgttcatgtgtccaaagcatcacgtctaacctctaggttacgatgaccccagagcttgcaaatcttggtggaagaattgcacggagcctgaagtatgtttttcatcggaaatggtgctcattaaagaaatacgtgcctgttagccatcacttggattgtacatgacatcgttgatgttgcgtgtgtgtgtgtgtgtgtgtgtgggtgcacgcacgcacttgtgtgtttacattttcttttccttctttgttcctccactaaagcagaaaaagtgttagaagatgtttaagagagatgtggaaacagagagaaatgcagttttatccactcttctctcttgtaagataaaaaatgtgtctctgggcagggcgcggtggctcacgcctgtaatcccagcactttgggaggctgaggtgggcgaatcatgaggtcaggagatcgagaccatcctggctaacacggtgaaattaaaccccatctctactaaaaatacaaaggattagccaggcgtggtggcgggcgcctgtagtcccagctactcgggaggctgaggcaggagaaaggctgaacccaggaggcagagcttgcagtgagccgagatccgcactctagcccgggcgacagagcaagactccatctcaaaaaaaaaaaaaaaaaaagtgtctctgggtgtttttaagccaaaagccattcttcaccaggagggcttgtgggaaagcagattctgactcagtaggtctggggtgaagcctgggatgctacttctccaatgcactcccaggcaacgcagcagccgccagtctgggagccatgcctgggagtggtggggccttagcacacagtgtgtgtccctgcctctggacacctcctgccatccctgctcttccctcccgctgctaagtctcgccctggtctccctgccttcttagagatggcgcttcctttagcaagtgtttgctccacttaaggattcagggaacatccgggctggagagatgctggagaccatcccgtccaactctcttcagttcccagttgcttttgtggcaagagctaaaaacccaactcaacccacacacgtttatatagacttgtggaaaatacaaagggctttttttttttggtgcgttttaaaatataaatggtatcatattgtgtgcgtcattctgtgcctgtttttctctcttagtaaccaatcttggaggttttttaggtcagcagagaaaaacctccccattaacagcagtacaacattccaggatctaaacaacagccttgacattactgacatttacggctggacaattctttgctaaggggctgtcctatgcattatagaatggttagcaacatcccaccggcatgattccagtagcacccctcgcccccatcagttgtgacaaccaaaatgtcatcagacattgctaaatgtgtcctgagaggcaaagctgccctggttgagaaccatggggataagatgtagaagagcaaattccaaagaggtaagatgagttacttcctggggcacaaggaaggactggaatggggatagagagttctcattctttatgacttcattcattcatccatttcatacatatttattaagcacctgccatgttccagacaccatgccaggtgctagggaggcagcagggaagaaaacaagccaataccttcctattgtggctctgccattctccctggggagacagacatgaaacaaacaaggaagacatcagtacggaagatgtgctaaaaactatgggagaaagtaggacaaggggagctgggagtgctggggcccaggtggggacttcagagcctcacatatgatgttttaatgtattaaaaggagaatatctccatgagttatttggatgatttaaaatttttttattacttgagcctaggagttcaagaccagcctgggcaacacagcaagacctttctctgcaaaaatttttttttaattagccagatgtggtggtgcacatctgtagttccaggtacatgggaggctgaggtgggaggatcacttgagcctgggaggtggaggctgcagtgagccatgatggtgccactgcactccagcctgggcgacagagagagaccttatctcaaaaaatattttttttttaagatggatgggctaagccagtcccagcctggctccctgaagcaaggagatctttcaaggggctgaacccgggtgcctgggcagcagctggcctcagccccccattccttccttcaaatccccttgcttaggacaataaactcctcaacaggtaccctcagctgcacttgcatggagctgcaccgccatcccaagagctcgtggtgggcctttgaggcaccctttctccatctgtgtgggttcctccagcccattgttaaaagatagtagtaatgtctaacatccctgtaaaaaaataatccccatgtttctcgaggccctaggtttctggtccctgctccctctctgactttttctcctcccactctcccccaactcactcagctccagccacactgactttctttctgctcctcaaacgttcaggctgggtcctgccactgggcctttgcacttgctgttcctaatgccaagtctttccccatggtctccccacagccagcttcttatcaaccaagtcccagctgacatgtcgcctccgcagagaggacatccccgaccaccccagccaaaggaggccttttctccaaatctccttacacgtctctctcacatgtgtgtttctgttacagtttgaatctgtgtccctgcccgaatctcctgttcaaccgtaatccccaatgttggagatggggcctggtgggaggtgattggatcatgagggcggtttctcatggtttcacaccatcccccttggagctgtcatcccaatagtgaattctcatgcgatctgcttgtttgaaagtgtgcggcacttcccctctctctttcttcctcctgcaccagccatgtgaagatgcctgtttccccttcaacttccgccatgagtaaaagctccccgaggcctcccaggaagcagatgccaccatgcttcctgtagagccagcagagctatgagccaattatacctcttctctttataaatgacccagcctcaggtatttctttatagcagtgtgagaacagactcatagtttccttcattgtacttgtgacttgatgaaatgattctgtttgattctttgccgggttgttgtcagctccataagaagaggactttatcttgttctctgtgtacaaacacatagtaggtgctctgtaagtacttgttgaacaaacatgtaaatgaatgaatgaatgagagccagtgtgatttggatgactgcgtgcatgtgctaagtaaactgttttccatgatctctggggttgtgtgtgtgtgtgtgtgtgtgtgtgtgtgttcagtttggtttttgccacatctttataccctctgttctattacaacttagcatttttctttttatataaagaaactcatttaaaggaatcttgacaatatcactagaaacagaaagccagtatcagcacatacttgctataaatagcaaaaaaaaaaaaaaaaaaaaaaaaagaaaagaaagaaagagagagagagaaagaaaggaaaaccctatgcatataaattccatgaagatgtgaaaaagttatcaaattctcacagggtatgattgctactgtagtttctaagcctgaggctttagaaaatcgatactctcttgaaaaaaaaaatttaagcctgaggctgttgtgtctttcttaaaaaggagattggcaggtgtcagagaggtgttcaagacaagttaactccaacccgaggctttctcaatgatctttctccaattcatcccaacacccacttgccgcagaccctgtggaaggccccagatccaaactcccttcctgctaacagcagctgtctggggagatttccttccagttgagccatccaaggactcctccccagcccttatctgtggaatggaaaaaatactagcccacacctcatagattaagagaatcaaatgagctcatttatagaaagcacatggaacaatgacaagcatgaaataatagtcactgatgtttactgagactaacagcatgtcacacccagtgcaaaatgcctcacgtcctcccacagagtcttcataacaacctttagctcatggaagtactatttttaccctatttggccaatgaaaaagcagaggcccaggaaggtgaagtaacttgtccaaggtcacacagcaaggaggcaatagagctgggatttgaaccccggctgcctgactccagagctgtacaaagccagataccacagaggctgggttattgttcgtccagacccatgttcccacaggtcctctcatcccttacctgctccctttctaccttgtatttctatcctcctgctctgaggagattcctctccctgaagatgcttgggcttgagggaaccaggaggagaggaggtgaagttggcctggatgactctgtggtcaggatcctaatgacccagtaattttcctccaagtccagtattctcaggattaagtcctaatcatccatctacccactcacccactcattcatccatctgtccatccatctatccatccatccattcatccactcacccatccattcatttacttattcatctattctcccattcacccatccatccacccacccacccacacatccacttatttacccacccatttcatccattcttccatccacccatctatccatctatctatccactcacctgtctatcaatccatccatccatttatccagccatccattcacccacccacccattcatctgtcctcaatccactcacccatccactcatttactcactcattcatctattctcccatccaccctttcatccactcacccaccatccatccatccatccatctacccatgcatccatccatccacccatccatccatccatccacccatctactcattgacccactcatttcacctattcttccatccacctatgtattcatccacccactcacccatctactcattcactcacccattcatctattctcccatctacccccattcatccaccagtccatccatccatccatgtaacatttactgaaggctcactacctgcctgcaaggttcaggtgagggacagagcaggactgtacaggtgtctctcagcctctaccctccctcattcctgcttccatcttcttctgatctgggataattcctctcctgggagatccaaggatgatggggagcaaaaggcggtggggtgaggggttggggcttcggcactgcctctctactgaggccccagtcccttctctgtatggacaaaatggaaacttgtggtttttcttcctgcattgaaccagcaggctgagctggggctgaactcctgggacattaaaagggggtgagaggtgaagatgcatccaggtggggggtgtgtgtgtgtgtgtgtgtgtgtgtgtgtgtgtgtgtgagagagagagagagagagagagagagagagagagaggaggtggagggcgaaaggcctgtgcatctctgtctctgtcaggcacacagagaatggcagtggtgagcctgcaatgtattgggaagacattattgtttgctcagaaatggccaagaaccccagctcctccctgccaggagacacaggattctgcgcctccaggcacaaccgtcttccctcccttccactttcctccctcctcctcaaacccttgcccaggtgccccccggctggctgggttcaccagaggatagatgaccacatactaatcccagcctcctgtggaggttagtcccaccctccaccgaggtggaaaattcctgcaggtagagtcagcagtggttcaagtcccaccgttgtccatgagatcggactacacagcacacacggccgcttttttttacctaccacgtgtcccacgtctcctacagtcctttaatccctgaccagtccttcagaggatggacacgctctgatctttgtagcctctctttctctcctcagggatcacacctcactgtagaccacagcccaatgtcccaggtgactcacttactagaatttgtaattcacttcatcctgccaccacgcccctgtgagctagacacccaaattgactccattttacagatttggagactgaggtgcagagagattaagtccctgtctgaggtcgcatggtggatgagcagcagacaccctggcgggcagcctggctcctgagccacgcgtcaccaccgtcttagtggaaaatcggccacaaggagggattccccttccagtctcctggcccttgccaaaggatccatactagacatgagaggaggaagggagtccacaccgagtctggcctcaaaccctcattccttaggaaactgcgctaatgtcgccccctccctccctgtgaccaccccaggttgtatctgcaccttcccagctagcccaggtgtcattacatatttatctgttgatcactcggctccagggactgccatatcggcccaggaagtcacgatcttgtctgtctggttaggggctgtggtctggcactgggcacatagtcagtattcaatgaattttggctaaagcccttttggatcgatcatctattgccagtgtggctcagatgcagcccccgccactgactgtgtgactctggcaggtcacaacccctctctgagcctcccttccatcatctgtaaaacagacttatctctgagtcctacacatgttaaacactcaaaggatttctgttgcatgaattagtgaaatccgagctggaagggcctctagagcccagggttgcaaactcatagactccaaaagccaggcaggagccagaaaccaccgagggagctgggtggggacggaggcagctgctactcagctctagtcacaagcactgccatatctggtttctcaagaaaaaccagaaatctagagatttacaagaagtttcccaatttctaagtattggcaactaatttaaaacatttaaacacatctgtggacgggatgtggctgcaggccgtttctttgcaactcatgattcatctaactgctcgtggcacagatgagatcaaagcccagagaaggtgagccaccagccccaggtcacagagcacaggaagtgaagaggaaacagtgacctttctccttcggctgcagccctgttgcccaagctcagggcaacccctgagccctgatcccaagggaggcagtgccgccttctcctctaggcctggcagttccagggtgacaggaaggtcacgatatctctgtttgggtgcactgcagcctccgcttcctgccaggaccaggctgtatcaggcactgggatgaagaaaacattccaagcaatgggctggcctagaaggtaagagctggtggcagagagggggtaagcacaccccttccttacttcagggacgtgcaaaccccttcagcaggcctgggcagagctgggaacagggcggatcaagccctgcttctggagaaacatgctctgccattggaggctgggagctctgtccccgcatggctcgtaggaccttggaatgcatttgtccagcagcttctaatacaccaggccctcatctgacccgcacccccacaacctccatgggctctcctccctctgtcccctcttgatctctctacgcaggcacaatggtgcctgctcagccctgaacacagcagccctgctcccacctcagggcctttgcacacgctattccctctgcctggttcacttcacccattatgcagatggcttactgtagacctctacttgaatgtcgccttctctgtgagaccctccctacctgttcactctgtttaaaaatgcaaacatcccccacagtccttagcctccatctggcttcctttgaccctgctgtgcttaggatggtgggacacatatgttacacgtgtttatttgtgtttccctttcctgttgctgctgtaacaaatcgccgtgaacttgggagctggaaataacatgaatgtgtgagcttacagttctggagggctgaagcccacagtgggtctcagcaggctaaaatcaaggtgtgggcaggaccacgttccttctagaggctcacagggagaatccgttcctccagcttctcaaggccacctgtattcctgggctcacggctccaacctccatcttcaaagccagcaacggcgaggccatctttcccatgctgcatccctccgcctgcaacacctctgcttccctcctgcactaagccccttgtgatgacactgggtcacgatgtcatcatctgggtaatccagggtcgtctcccccagctcaaggagactgctcagcagcctccattccccttggccgtgtaaccttgtacattcacgggttccagggatgaggacgtcttggggaagggcgcatgagtctgctgaccacacacaccaaacacaccaggcgttggctccaggaaggcacgtggtttgctgctttatgtatgtccaatgcctggtgcatagcaggtgctcagtagacccttggagactgcgtgggtgctggagtagaatgttgtggccgccaaagggaggcaggaaaggtgactcagctaccccagtggtcctccccgtcttactgatgaggagactcggggagagctgagatgctgagggctgaagagctgtgacttagcccctacccttccacacccatcctgtgcccacaaagaggggtgggccctgggctgtgtcggggagccccaaagagaaggcctgaagtccggcagctttaaaggggacagtcctggccatgagccctctctctgagcgcccctcacaacccctacaagctcccctcccaaggctaggccagcagtgcctgcagggggctgcccaggcgtggtcctgccatgtgggaactgcctgtgtggcccagcaggacccagatgagtcacaggaaagctggggtgccctccctccagccccacgtgtctccctggcttcaaaggaaaccgactgagggtccaagtttcctcatgactgaaaaatgttccaccccaaaaatgttccacatgagcaacagctcacccagaaagaaagagaaatgaagtaagtggcttttcagcatggggagagacacttggccatgcacagctacaggcagagatctgggaaacagaacgccggggaaagcaagtgaggaacaggagaactctgcaaatcagaacactcatcataaaataattctgcttgtttcacaaggacacatatacatccagggacatatatcatgggcctcggtatggaggctcaaggagaaaacaaaacaaaataatttattttgttttaaattattattattatttgagacggagtctcgctcttgttgcccaggctggagtgcaatggcctgatctcagctcactgcaacctcaacctcccgggttcaagcgattctcctgcctcagcctccccagtagctgggattacaggctcgcgccaccacgcctggctgatttttgtatttttagtagagatggagtttcaccatgttggccaggctggtcttgaactcccgacctcaggcgatccacccgcctcaacctcccaaagtgctgggattacaggcgtgagccactgcgcctggcctaaattattattatatgtttattttgttttaaattatttttatattttacaatggagcttcctgacatgtgacaatgatgctacggttttttgttgctgtttttttgtttgtttttgagatagagtctcactctgtcacccaggctggagtgcagtggcacaatctcggctcactgcagcctctacctcccacgttcaagagattctcctgcctcagactcccgagtagctgggagaacaggtgcccaccaccacgcctggctaattttttgtatttttagtagagacagggttttgccatgttggccaggctggtctcaaactcccgacctcaggtgatccgccacctcggcctcccaaagtgctgggattacaggcgtgagtcactgcgcctggccaatgacactatgcttcactgaacaagcaaaaggtactctgcttcactcttcatttaaaaatagaaactgaaaccatactgagacacctgcttccatctattagagtgacaaaaacatcagaaagttcacaatacatggtgctgatgaagttgtggggaaacaggcaccctcacacattgttggtgggagaataaattggtacaacctctacaaagtgcagtttggtcatatggatcaaaatgtaaaatgcacaaatctgttataaaatctgacttccagagatttctcccacagatacattcacacacacacacacacacacacacacacacacacacacacaccacactatgtacaaagacagtcaccacagtattgtttgtagttgttgttgttttgagacagggccttgctctgtcaggctggagtgcagtggcgcaatcacagctcacagcagccttaacctcctgggctcagtgaccctcccaccttagcctcctgagtagctggaaccacaggcacgcaccaccacaaccagcttgttatttcatttgtaaacatgaagtctctctatgttgctgtggctggtctcaagctcctgggctcaagcaatcctccagcctcagcctcccaaagtgctgggattataggcgtgagcttctgtgcctggtccacagtattgctttataacagaaaaggctggaaacaacctaaagggccatcagtaagaaaataactattaatgaatatggtccggccatgcagtggaatactatgcagctgtgaaaaaggacaacacaggtatgtgtgatgaattagaaagaatgataggtatgttaggttaaaaaaagcaagctgcaagacactgggtgtaacatgcatctatatatgtaaataaagagtgcatacaatcatgtgtgttttcgtacgtacagactttcagtggcagagcccgtgggaaactggaagcagcattgcttagggaaagtgaaacctgggggttaagggtggggagagacactcgttttcattggatacttttttctgtcattgaattttttcccatttaaatgtcttacctatgttttaaacataatttttaaaatataaaagcaatgctcacttgtcacaaaatctaagcaatgaaatgcaaatgatatgaaaccagttgtccctaaccactcccctgaaatcactactattaacatctttccagagttaacaaaaggtcttaagtttagatatgcttctttttttttttttttttttttttttgagacagagtctcactctgtcacccaggctggagtgcagtgaaacaatcttggctcactgcaacctctgcctcctgggttcaagcaattctctgcctcagcctcccgagtagctgggattacaggcgcccaccacaatgcccagctaatttttgtatttttagtagagacagggtttcaccatcttggccaggcaggtcttgaactcctgacctcgtgatccacccgccttggcctcccaaagtgctgggattacaggtgtaagccaccgcacccggcctagatatgcttctatattattcgaacttgtgcaacaggctgtgtgatttgaaattaaacacaagggccaggcacagtggctcatgcttggaatcccagcactttgggaggccaaggcaggtggatcgcttgagtctaggagttcaagaccagcccgggtgacatggcgaaaccccatctctaaaaataataaataaataaacaaatagatagatagataaataaaggaaattgaacacaaaacctcccttttgagtcaacgattatcaaggaggctgttatagttgcagaggtggcctggacagagtggtggccatagagacagagaagtggccagttgtaggagcaaatgtcacaggttcaactgacagggtcagacgcacaggcagggagaaacaggagggaggacatgccatgagctcccttgtctaggcccacactgaggtgacacggcccaagtgccccagcccgacagggtagactgcgatcagggtcaggaattcagtgaggcaggtcctggagcactgggagggggtacgagggtctcagatatctggggctgggactcttgaggtcatagcaagataagtggatgacatactcagtttcaagagttaaaccccagatttacatggctgcctggagtctggattcactggtgtgaaatttggagggagatgacgataataagaatactaatactaacagtaacaataactatcataagaacagaggccaacactctgtagcacttactacaggccaagtgctatatacgtgttaactcataatcccacaatcaccctctagatataggtgggtatagagaagcatgcccccatttcacagatgagaaaactgaggcccagagaggtgaagtaatttgcccacggtcacacagcttgtatgggatagagaagggcagggcgtatcactgaacaaaatggaggtcccttcaccccagagttgcaaacccagcctccctcactcccactacccctctgggcctcactgcatggatggacagtggcaacaacccctcctgggcctccctgactctaccctcgtcccccattccccacaacagtcccttctctatccagcggccagagcgatcttcctaaagttctagtctcatcttcccttggtctgctctcaggcagggccaggcattaggtgaggccagcaggtgccggcacaatgtcaggagacccccctcccaggtgagcccctgctctggcctgattcacagcgaggcctccttaggttttgaacactcagtgtccctcttgcacagatgggaacagacagtctctggaatccccccaaagccgcatttgaagtttctttccaggcagacaggccctttccaggcggatggctgcttcaatccagatgaggatggaggcctggggatctggcagctctgggctgatggcaccacgtccaggggagaggtttctgttttcctgcagtggttctctggcctatgcttgctggatgggggtgttggtaaatcctccagcttcctggggcctggggaggagcaaccctgaggtggactctgcacccactcccagaggccccagcaggacggagccccagctgcccaactgataacctgctcatctagacacccagcagtaccagctgccccctcccctctgctctcagagcttcctgcgatcagctccccgctaagttccctgcccttggactctctaagtgtctgcttctggaagaggcccaagccaagacctgggagacaggtcagtggctcagggctctgtggctcatgatatctgcagtattctctctgtggcctgggtcttcctgtcttctgggtgatccctcggcctttgggaggccgaggtggttggatcacctgaagtcaggagtttgagaccagccagcctgtccaacatggtgaaaccccgtctctactaaaaatacaaaattagccaggcatcatggggcacacctgtaatcccagctactcgggaggctgaggcaggagaatcgcttgaaccccggagggggaggttgcaatgagccaagatcacgccattacactccagcccgggcaacaagagtgaaactctgtctcaaaaaaaggaaaagaagagaaaagaaaagagagaagaaaagaaaagaaggcaaggaagttccatagcccatacagtgggtatcttaggcagggctctatcagatgaaaaatatagcagaaccctgactcaaattggctgatgtcatgagaatttacgtcaactgtctctggtaaaagcaggagtagagataggcttcaggcatggttggatccagatgctaaatcaatgtctacaaagatgcactacctctggctctcatctcttttactccacacagactctccaggtcatgatgtgaccaaggttgccccttgccactcccagctttattctcaccagctcagcaaccccagggaaaagggagcaccaatttccaattgtttcagaacaaggtcagtggcaatgttactcaaactcgaacgtgcccatgttcacactggggccctggggactatgataaaatgcagattctggctcataggtttggggtggggactcagatgctgcattcactgcattttttttaagatagagtcttgctctgttgcccaggctggagtacagtggcatgatcacagctcactgcaacctccactcctggcctcaagtaatcctcctgcctcagcctcccaagtaactgggacttcaggtgcatgccattatacccagttaatttttgtattttttgtagagacctggtcttactgtgtcacccaggctcgtcttgaactcctgaacccaagtgatccacccacctcggcctcccaaagtgctaagattacaggtgcgagccaccccgaccagcccagatgctgcatttctaacaagctcccaggtgctccttgtgctgctgatctggaaccatacgttgagtaggaaggtctttgcatgatgccattcctctcagctaaaagcacattgtaggccaggcatggtggttcacgcctataatcccagcactttgggaggccgaggcaggtggatcacctgaggtcaggagatcgagaccagcctggccaacatggcgaaactctgtctctactaaaaatacaaaaattagctgggcgtggtggcgggcgcctgtaattctagctactctggaggctgaggcagtagaatcacttgaacccgggaggcggaggttgcagtgggctgagattgcagcattgcactccagcctgggtgatgagagcaaacctccatctcaaaaaaaaaaaaaaaagcacattgtatacatatgcagaatattcatctaaagaaaaatcgtaatcaaaattaaaaagtaaaagcacattgtgcacacacaggaaactattgctgcatcccaagagtcccgcatgcagtagctcatcaactggtcacaaggacgttagaggtgggtgctctcattacctcatttctccacaaggcccagacacattcccaagcctgcacagctgggaagcagcgaagctgctttgaccccaagtaatgaattctccagatggaataaacaagggccctgctgatggcccttaatgctctttgcaatcctcctctattacaaaaccaccgtgctgagcaaccccacaggtgcgtgtgtttgtaagcatgcactagtaggtttggggaaagagattcctacaggcgaaattgctgtatcaaaagatgatgtatggttctattattgctaggggctgccaaaagggaaagagactgcccatttccccacatccatgccagaactgcatgttcttgtttttgccactctggggagaggcgcccttcctcatggccctaggaaggtagtgaagttatgtcccagccccaggtaggcagcctccttcctgcaaggggtcatccagggagcaccctgtgccagcccacctctgggcatcctgttgtcatggaaatatttcaaggcctgctttcatcctgaatagcaacttcagtggaaagagaaggcctctgttatgggctaaattgtggtccctcaaaattcatatgttgaagtcccaacccccaagacctgaaaatatgactgcatttagagatggggtctttaaagaggtggttacgtttaaatggttgttagggtgggccctaatccagtctgcccggtgtccttataagaagaacagacctcaggagcgcacatgcacagagggatgaccgtgtgcagaggcagcaagagggtcgccatctgcaggccaaagagagaggccttgacggaaatcaaccctgacagccggcatctcgagcttggacttccagcctccagcactgtgagataataactgtgttgcttaagccacccggtctgtggtcttttgctatggcagttctagcgaacaaatatagtctctttccctgcacacctagaagagttcctgggaagatgcccatatgcctggcttggttcacttcccgtctgttaccaattgctgtggccaccagatgctgaactctaatcggtcaggccttggccaagtgctcatccctggagctagggatgggctcagcctgccaacctgggttcacttttccttgtttgattaaaaattttaatttaaagcaagtgacggctggatgcaatggctcacttctataattccaaccttttgggaggccaaggtggaaggatcacttcagccccagagttcgagaccagcctgggcaacacagcgaaacctcaactctacaaaaaatatttaaaacttagccaggtgtggtggcacccacctgtggtcccagccacttgggaagctgaggtgggaagatcactcgagcctgggggatcaaagctgcagtgagctgtgattgcaccactgcactacagcctgggtaacagagcgagaccctgtctaaaaaaaaaaaagaagaaagtgaggtcgaacctgtggctaacaaggggataatttacatgtctgagctcaagttcagatgtacaagttggattctcttttcttttttggggggtggggacagagtctcactctgtcgcccaggctggagtgcagtggcgtgatctcggcttactgcaacctccgcctcccgggttcaagcgattctcctgcctcagcctcccgagtagctgggattataggcacccgccaccatgcccagctaatttttgtatttttggtagagatggggtttcaccatgttggccaggctggtcttgaactcctgacctcaagtggtccacccgcctcggcctcccaaagtgctggtattacagacgtgagccactgcacctggccatcaaaattagaagtctttttaaaagtccctttgatcccacccatggtaggcaaaccctacctcaggcatcgggtcaggctgcaatttccaactcatatctgcttttagcccctggagatttcacttaaatcctgtgagctcagccatctatccccaagatgcagttcctccaagatacctggcaggcaccctggcaggagggtgtcacggttctctaacctggctgactactgagcctctgggctccatgaggacaggatgtctctctcactcgctgctagcccagtccctggcacagccctggggcttggcaaatatttgttgaatgaataaacaggctgtggcttataagctggttcagattccagctccccactcactccgcatggaagaatcacttcaatcctccaagccccccgttcttcatctgcatgggggatattttgttgttattgttgttttttaaacttgggatttttttttttttgaaaaatagaacagatacagatacaaaaaccacacagcataagcatgtgacttaatgatttattataaggcaactgaacaccctcgtgaccacctctaggtcaagaaatgtaactttgcctgccacccctggaaacccctgcagaaccctgtcctctcaaagccctgcccctcccaaaagtcactgctaccctaagtgttatggatatcacttgtgtttctttcttgttttaccaaccatgtgagcagccccagacactatacttaatcttgcccactttttaaaaacttgatgtctcttttagtttctattcctcctccatccctttcttttccttacaatttacctgcgcagtacctgggccatttaacctgcagagatccctgggtctgggttaggctgatgacagcaccgtgtcatggttcaacacgttctgtccttgggattttctgtaaaacggcagctggatcctgaggctacaccagggatgtttccaagcttctgccctcacgggtcgtggtgagaattgaagggggatgggtgagtgtttgatatcagcgagcagcccccagaagcagccgccaaggctgttcggagatgctcacgaggcctgaacatggacagcccgagggacatcccatctcaacagtccatcctggcttctctccccacccagacccacccaccccactttgggaaagttctagggccatggctggctcatcccagcgagagctggcagcagaatggcctgtaattttagctgtttctcttccctaaaattatttcccatctggaaatggtttcccaaccctgcccaggaaagagttggtggtgcaaggaacatttttctattaaaaaaaaaaaataggggccgggcactgaggcaggagaatcgcttgaacccggcaggcggaggttgtggcgagccaagatcgtgccactgcactccagcctgggcaacagagcaaaactccgtctcaaataaatatataaaaccagccaccaaacactgaatctttgcagcccaggctctggaggcctggctgagtgccagctgtataccctgccttgagggaactctgtcagcgaggagcagagggtgagagggcatagtcagggctctgctgccaggatacccccacccacccagtacattcggacaaggactttgttgcagggcctgggacagccccaggcgagctgagaaggatccgacctggggttgagtggcctgcccagctgctgccacactcgaggtctgtgggttattctaggtcccacagggcatgaaatcacagagcagaagttcttcctatggggattctcttgcagctgctctgagcatttcaagaaaaaaaaaaaatccctgccgctaacatctccccatcacctcgctaattctcttctttctttcctttttttttttttttttttgagacggagtctcgctctgtggccaggctggagtgcaatggtgccatctcagctcactgtaacctctgactccctggttcaagcgattctcctgcctcagcctcctgagtagctgggattacaggtgcccgccaccacacccagctaatttttgtatttttagtagagacggggtttcaccatgttggccaggatggtcttgatctcctgacctcgtgatccgcccacctcggcctcccaaagtgctgggattacaggcttgagccgccgaactctcttctttctaacaaagttctcacaggcccctgactcctgactgtgcaagcaagagcatctggcaagaatatcatgatattttttagcacttcttgtacttattttcataattttttttttgagacagagtctcactctgtcaccctggcttgagtgcagtggcaccatctcagctcaacctgcaacctccgcctcctgggttcaagtgattctcctgcctcagcctccttagtagctgagattacaggtgtgcaccaccatgcctggctaatttttgtatttttagtagggacaaggtttcaccatattggccaggcagtcttgaacttctgacctcaggtgatctgcctgccttgacctcccaaagcgctgagattacaggcgtgagccgccatgtccagccttattttcttatttccttttttttttttttagacggaagctcactctgttgcccaggctggagtgcagtggcatgatctcggctcaccacaacctccgccttctgggttcaagcgattcttctgcctcagcctcccaagtagctgggactacaggcatgcgccaccatagctggctaatttttatatttttagtagagttggggtttcactatgttggccaggctggtctcgaactactgaccttgttatctgcccacctcagcctcccaaagtgctgggattacaggtgtgagccatcgtgcctggcacccagccttattttcataactgttttcatgataaatgatataggttttccatgtttgctaatgatataaagtttcctctgcagaaacaggtttaaagaaaaatgtgggcagaaagtccgtttaaaatatatattaaggaaaataaaacacagatagcacaaaatccaaagctacctggagttttggtgcctggagccatggtgaagagggcatactccagatctgagggcccaggcttgcattctggctgtgactctgtgggccctgtgattttaggcaagtcacttgccttctctgagtcatggtgctttacctgtaaaagaaaggaaaataataacacctccttcctatgatgatctctgagaattcaataaaacaatgctgagaagacactcagcccagtaccaggcacatgggttgcatttaattctgtcagaacacaaggtgggtgctatttttattcctgttgggaagctgaggcccagagaggtcatctagcccatccaaggttgcacagcttgtaggtggtggaggtggaactagaacccacaaagttctaatgtgagactgggatttgtgctcttaaaccactgtgctgctattggcagatccatctatccacccatccatctgtccgtccatccatccatccatccatccatccacccacccatccatccatccacccacccacccatacattcattcatttggtcagaattcatggaattgttctgagttcatggtgttttctcaaaaagcagcaaagtgcagaagttcccagagtaggttcaaatcccaacctgccatgtacaggacacctgggcaagttgtcccacctctccgagcctcagcttgcccatctggaagaggggaacattgatagccctttgaaattcccgcaggaggtagaagactgttttctgggacttcacagtgtcctacgtgccctgcatctgaccccatggtctgcgttcacctctaagtctcagtgaatcaagctccgccatatgtctgcctcatcctgcctccctcctccctttcactccaatttagccagactcagccattggggttccctgaacagcccctgggcctttgtacactttgttcctccagcccgaaatgtcctcttgcttccatctggtaaccatgattcctccctgaaaaatcaggtgggcttccccctctgccccaggagcatcccctgaggctgagccaagctctgcctttctgggctcccccagctccccgcttctctgacatggaaaggtcatggatgtaataacttagacaaactcttgtgctctgccactgtccaccttcttggtcacaaatgtctgcttcccttctttcatgcaggtacatgcacccctctgcaaacgagtccacacacatgtttttacacaatcatggcatgtgatccgaaggcatgagatctgccttcgtacatgcaacatgcaatggtggaacggcattacctctggctagtgacctctcctggactcagctatcacctctgcagaaagggggcagtaacaggacctgccgcacatctgctgtcatgaagaccacatgagctaatatatgtgggaagcccttagcacagcgcctgggagagcataagcgctcgatgcaaggcagaagaaaggcgtgtcctggtgtgacagggcccttccgaccagggctggtactaaggtgagaaaagcgaggtgcctaccgtgcaaaatgtaaggcagcgttcactctcagagcagtgcacctgccgctgggtcctcggagccacagagcagtcccgctcgccccctgctggtcactctgcagaatgacgtcccttccctctgctctcaggggtccctgagcctcggtttcttcacctgtaaggtggggtaggagaatctgcctctcagtttgcagggcaaacaggaggcactcctccaacatcagtgtcctcctctcaatgccagcacttaatgagcacctactatgtgcaaagaaagatgactgagacatgatccctacccttcaggggtttagcgagtggagaggggaggaggtaggctgggaacagtgactaaagtaagacacttgtccctatgcagcacctactgcttaccccagagcagtcagaaccactgccctggcatctgtccatctgcatatgtttactaagcacctactgtgtgcctgagcccaggctcagctgtggatttacatggattaaggggtttaatgctgtcagaacacaaggtgggtgttctttttattcctgttgggaagctgagggccagagaggtcatctagcccatccaagcttgcacagcttgtaggtggtggaggtggaaccagaacccccaaagttctaatgtgaggctgggatttgtgctcttaaaccgctatgctgctattggcagatccatccatccacccatccatccacctacccatccatctatccaaccatccatccatctatccatccatccccatccgtccatccacccacccatccattcattcaacaaatattcgttgagcacctactgagtgccagacacagtgctgagtgctggagagatgccagtgaccagaaagacacagcccatccctgcccccagcagctgttcacaaagagaggatgggcaataagcaagacaaataagtaaaatatatggcacttggtgattcttgctgtatataaaaatagagtaaaagctgtgcacggtggctcacacctgtaatcccagcactttgggaggctgaggcgggaggatcacctgatcccaggagtttggaaccagcctgggcaacatagcatagtacagaccctgtctctactaaaaacacaaaaaattagctgggcatggtggctcatgcctgtagtcccacctacttgggagactgaggtgggaggattgcctgagcctagtcgagatcgaggctgcagtgagccgtgattgtgtcactgaactccagtccaggtgacacagcgagaccctttctcaaaaaggctgggcgcggtggctcacgcctgtaatcccagcactttgggaggccgaggctggtgaatcacttgaggtcaggagtttgagaccagcctggccagcatggtgaaaccctgcctttactaaaaatacaaaaattagctgggcgtggtggcgtgcctctcaggtactcgggaggttgaggcacgagaatcgcttgaacctgggaggtggaggttgcagtgagccgagatcgcaccactgcactccagcctgggtgacagagcgagaccctgtcttaaaaaaaaaaaaaaaaaaaaaaaaaaggcagcacagaagactgagagggtggggctggagtgtgtttcaattttaaattaggccttgagggccattgagggaccttggctctcattgtgagtgagctgggagtcatggagggttctgagcaggggaggagcctggcctgacttaggcccttgcagaatcactccaccaggaggccagagtgttaggacccagggtggaggctgcgagctcggggaggaggtgaccgcacacaggatggcggctgggcttggcggggcagtggagtggggagacagagtctggatgtatcctgaaggtggaacagacaggattagctggtggatgggacatgtcggtggcagacagagaggagtcggggatgaatgactccctgagcctctggggagggtggagctggctgcccttaaggctaagaaggctgtgggcagagcaggtttctgcgggagatgaggagtgggttgcggatgcattcaccctgagttgcctggcagtgtggacgtggagtttgggtttaccctcgtgttgacaggtacacgctcgcggtgcggttatcacgctgctgctggtgtcaccacgcgggcgctgcagggacggacctttcccatcgccaggctcttcggggactgctgcaatgccccgtgcagccgccagggagcgcccgagccgcacccaggacgcgcggggaccgggtcatcccgcgggctacctgtgcggggcaggacgcttagccgcacccttggcctccgactactcggagtctgttgcattcctccttccccccgcgcgccgtgtgacagccaaaactgtccccagacattgccaggcgccccctggaggggaaagtcgcccccacggcagtcagagccatggcctgcgcagccacattcatttactgagcgcctactgtgtgcctgcgtctgggctccgcaggggctcacgggggtttctccttttcatccaggtttctgttcagatgtcaccacctcagaaagaccctgtcctagacacgctccattcaatgacccgaaaggatcttgttgaaatgttaacttattacatttttgggtttttgttgttgttgtttttggttttgctttgagacaaggtcttgctctgtcacccaagctggagtgcagtggcacaatctaggctcactgcagcctcaacctcctgggttcaagtgatccttccacctcagcctccaagtagctgggaccacaggtgtgcaccaccacacccggctatttttttttttttttttttttttagtagagacagggtctcactatgttgcccaggctagtctcaaacttctgggttcaagtgatcctcctgcctctgcctcccaaagtgctgggattatgccactctgcctagccttctttattgtctgtctcccctacccagcagacaaacccctgccctcttagagtgcaacttccagtgagccagatggtcacctctttgaagtggtggcatttgagttgtgccttgaaggatagaagctgccgatcatggcagaatttgaagaaaggtctttcctggcagagggaaaagtcagggcgaaggcctaggggctgctcaagtccctgccttaaggcatttagagcgtcctgcccagtgggtgatgggtccccaggccacacacagctgctggccgagcgccccaagtcatcaggaagccatgtggtgtggacaagggccaggcagcctggacacacaaaggcccattgacagctgcatgggaaaagtccagggcacccaagccggaagcccaaggctggtccctcttgtcaactcccaaggagctttgggtggggacaatagaaaagccagaccttctcaggagactcaagtttccctggggtggggcaaaaatgcaggtggcctggtcactgggacatgcagggcagctgtgtgaggcttttgcagtcccccagccctggttctaagtctagccctgccccctgctagcagagtgaccttggtcatgtcatgctccctctcagaccctaagttccctcatctctaacacagggtgaaagctgggtgcagtggctcacacctgtaatcccagcattttgggaggccaaagtgggtagatcgcttgagtccaggagtttgagaccagctgagcaacatggtgaaacctcgtctctacaaaaaatacaaaaattagctgggcatggtggcacacgcctgtagtcccagctactcgggaggctgaggtgggacaatcacttgagctagcaaggttgaggctgcagtgagcgaagatcacgcaactgcactccagcctgggcaacagagcaacactcagtctaaataaataaataaataaatacaatggggtgaaaaatagaagcaaccttccagcaatggtgtgagactgcctgggtagagtagtgggaaccaggcctgattcagcaggtgtttaagagcaggtggtcagttccagcagtcagctatagtggctggctggagtggccatctgtggcggtcagtagtggtggtcggtcatagtagtcaactttcatggtcggctatcacgacactaagcatgaggaccgtcaggtgagcatggctggggtgtttggtcagacagacctgggttccacaggtctcctgctttccagtgtggggcagatatgatctcctttttccaagcctctgttcctccatctgtaagatggggataatgagagccctacacagggcaatgactgtgaagcgcccagcactgggattatagaatgttccagggctttggagggcagcctcagaagagcaggccaaggaaagcgcaggcctcccgactgaaggaggtctgcagagccagcaggtaaagagtggctataaacgaacaggagctgggcctccctccgcgggcagtggggacgcatgagggcatgttcccagcctgatagcaggaagcatttctggaaaagcccagctgaatagtgaagatagcagagcaggaatgtgaagaacgcagacctgggatcagcttgctgggctcaagtcccctgtactagctgtgtgtccttgggcaagttacttgacctctctgtgccttggtttcctcatctgtgaaacagggataagatcaacctaactaggctatggggttgatgtgaggtcctgatgagagaatatttctacaaagaatgacagataggctgagggccttaaacgatgacgcaggccaggcatggtggtgtgtgcctatagtcccagctactaaggaggctgaggtaggaggatcgcttgagcctgtgaggttgaggctacagtgagccgagattgcaccactgcactccagcctgggtgacagagccagaccctgtctcaaaataaataaatgatgttggactgagaaagcatcaacactcacccaggctctggggggaaggtggatgtgagcaaggccaggaagagccaggaggaataggaggcaacccctgtatgtttgtgtgagcgcagccaggtgccagggtcgggggcggcaggagcagaaaccctgagaatgtaaaacaattcagcagcggccgggcacggtggctcacgcctgtaatcccagcactttgggaggccgagacgggcagatcacgagatcagaagatcgagaccatcctggctaacacggtgaaaccccgtgtctactaaaaatacaataaaaattagccaggcgtggtggcgggcgcctgtagtcccagctactcgggaggctgaggcaggagaatggtgtgaacctgggaggcagagcttgcagtgagccgagattgcgccactgtactccagcctgggtgactgagcgagattccatctcaaaacaaacaaacaaacaaacaaacaaacaaacaaaaaattcggcagcagtggcaatggcctcagggactctgagagctactaacacagccacctggacccacataggaaaagcaagcattctgagatcggaagtatgaactttggcctgggacaatagggagccactgaaggtttggtagtcaagggtcagcccctcttaccctgagagttgatataactaggatactccacagcttcatccccagcacctacctcggggcctgcaacatagtaggtgctcagggaaatgattttaaatgaagaaatgcattaatgggtgaatgagaaactggctactaaaagctggccttattttgcccttcacccacatagcactgggtacctccagggacttagatacagagggaccagcaaaggtaaatgtccggagtgggaacaagctcagggagacagaggagcagtgaggaggccagagaggctggagtagagaaaacaaagggagaacggggaggggaggccccgcggaggtgagccggctggacctctcaaggccttgcgagtagggaatagcgctttcttccaagtgcagtgggagcctccagagggtttggtggttgtgtgtgtgtgtgtgtgtgtgggggggggggggtttgtttgattggtttgttgttgttgttgttattgttgttgttgtcgtcattgtttttcagacgaggtgttgctctgtcacccaggctggagagcagtggtgcaatctcagctcactgcagcctcgacctcacaggctcaagcgatcctcctacctcagcctccagagtagctgggactacaggcacgcaccaccatgcctggctattttttttattttttgtggagacagggtctcgccatgttgccagggctggtctcaaactcctggactcaagcgatcctcccgccttggcctcccaaagtgcttggattacaggcatgagacaccatgcccagacagttgcattttaaatcctcctatcaaagagcataggcattattatccccatttcacggatgaggaaactgatgctcagagattgaatgatttacctaaggtcacacagctacgtagagacagtgccaggattcagcctcagcccattgggctgtgggatctgcagggctggaggggatagaacaatgccagctggagccagcactgctccccatctgctaagctctgccctacgacctctaggtgacactgggtgttggcaggcatgaaggacctacaccgtgggactgtggggaacacgaccaggccctgatcagtaggtctgctgagtcaccaggcctggcccagagctaacctccggcagccaggagccgccccagggtccgtccttggtgccctgcccagcagctgccaagcacagccactgccacatgagctggatgtcctgcagaagccagagtgacaaactacccccaaatctgccctcctccctgtgctgtgtggcctctggcaagtcccctgccctccctggcctgcggtgcacctgctgtctcgtgcaagccccaggccgcagtgcccctccctttgtgctgggtagaatcctggccaattgctgataccgagtttagaccggagggcagaaaggcgggacaggtaagtgcagacagtggggaaggctgtgggccccacaggactagactcttgtgggtgtggcggaggacaaggctgcccatcagagccccaggggcccaggctccacccaggtaacaggacac

SEQ ID NO: 1114 - DNA, 18527786 bp, Homo sapiens; identical to SEQ ID NO: 27
  misc_feature (4041202)..(4061201): n is a, c, g, or t

SEQ ID NO: 1115 - DNA, 1463 bp, Homo sapiens
accacacacacagcataaatagttaagcctactaatgaaatatcctgtcatttcctctacttaatagaaggctacagataggcttatacagtaaacatgtgaaaggtacagttgacttctctgcttgaatttgcacatggggggaattcgttctcttcttttgcccttttcacagaaccgtaaaatgtgaggactgaaggcaccttggaggatgcccagttcatccactggtggggaactgaagactagacagttacacggtagttcaaatgcaatcatatcactgcaattaaaactatgagaagactagattattctgtaatatcaccacattaggaatatgaatcactgtcaaatagcagatgcacatcatatggatatgattgatgtgatcacatcacttcttttagagtctgtggatgactggtcactgtgtattggtttttagttcatgcatacaaggcaaagtgtgtagtgttgttaccttcttgttccccagtgatccaagatttacaaaaaatgaataagtggaaattggctaacagatgaaagtacatcaaagaaacaaaaagtgataacattgggaactggaattccaattgaacataaaggagttctaaaaggatgacctggctatggaaggatgacagtcctgccctttgactgcctgtaaatacgcacccagaggaacttagtgaaagtgagcttattgacgtgtgcaaggaaaatggttctgacccataggatgtaggtgttccagagtaaatgacaccaggtgaaaaacttcacattaaagaaccctcagagatatttcagcacgttgaaagcacaaaggagaaaattcccgaaggtgattcaaatgtaggagcatgacaatttgtccagggatagcaaagatgcttattccactgggacagttatattgtgggatgagtgaaggcaggtcacaagtgttttacaaaggaataaaacactttgatggggtgccgtgggtcacacctgtaatcccagcactttgggagaccaaggtgggcagatcgcttaagtccaggagttctagaccagcctgggcaacatggtgagaccctgtctctacaaaaataaaataaaataaataaaacacgttaattctcaatgtttccagtcttctaaattatagtgtactaagtacatttagttttattatttagaaaatgttgtctatacatttataaatcatagggagtttgtcatgtttggacaaaaattcttaaaggtcatggaacaatgataaacaatgtgaattttcccaaagcttgtctgaagacatttttatggtcctgtactagcatgcaaactgaggactgcctgtattttaaatgaataaatatagactgagtgaaagtccaaaaatattggcttcttttatttggaattatctcagcttattctgttaactacttatttgctttaacaaaaacaaa

SEQ ID NO: 1116 - DNA, 4649 bp, Homo sapiens
cttcgaggttggaccaagtaaatgaatatctgtttggtaacattgttgacactgctgtatcgagctgctctaagaaagggaaacatttttggttcagaggacattcacagcactgtgcttgttggagtatttgtaccattgcctcttccaacagttacattttgctcttctttccctcaagagtagaagagggtggagaagaggaaatgattataattcattcctttcccctccctgccaatttctcacaatacccttattgggaggccaaggcaggtggatcacttgaggtcaggagttcaagaccagcctggccaacatggcgaaaccctgtctctaccaaaaatacaaaaattagccgggcgcggtggcaggtgcctgttgtcccagctactcaggagactgtgggaggagaatcgcttgaacctgggaggcggaggttgcagtgagctgaggtcgtgccgctgcactctagcctgggtgacagaatgagactccgtctctttaaaaaaaaaaaaaaaaaaaaaaggcacatttgaagttctgagtgtgaagtgtgcttcaggatagtaaatggaaatggcaaaagaaaatatccagtggaaatctttgccatctttgggattctctttagtttttgctcatttttgcctatcctgcaagggtaacagaaagctctgagatttggaggtcagacaaacctgtctggctcctgccctgattctgctccttgagggttctagtgcagggaggacctctggcaagttggaggattgtacctctctgagctagagaactggcagaaggacaaaatgtaatttactccactgtaagcccttggaaagcaggtaccttgtctgtttggcaccccagtggcagcccatgcccagcagctgtcattggttgggggtgggtggtgggtgagtgcaccctagtgggtagttggaggattaaatgagatagtatgcaaatagaggagagtaggtaagttccccctccatcactggatgtttttgctacttcccctactcttttgtttgtttgtttgagatggagttttgcttttgttgtccaggctaggtgcaacggtgcaatctcaacacactgtgacctccgcttcccgggttcaagcgattctcctgcctcagcctcctgagtagctgggattacaagcgtccaccaccacgcctggctaattttttgtattttagtagagatggggtttcaccatgttggtcaggctggtctcgaactcctgacctcaggtgatccgcccgcctcggcctcccagagtgctgggattacaggcgtgagccaccgtgcccggccccctcctctctttttatctctctgctctttagttagctggcctcatgattcccatttttattttgtttaccttttctgttaaagaaatttttgcccaggctaccctttaggcagggaggagaacttccccctacctcttctttctaagctacaacatcaaaaaaaaaaaaaaaaaaattagctaatggctctccccttccaggcaaatttctaggattaaacgacttgatgcttttttgctctgatccaggcccacctttccagcccacatatagtaataattatggttttatgtttttagggctccacttttgtttgatttatctccccatgaggatgtaagcctcttaggaatggggatcatgattcttcctgacttttaaaataacaactgtttctggctcctatttggtttatgctccatcatgtaatttgctgtcattcttgtattcagctgatttatccttaatcctgtatctcggttgtttgcttttttatccctaagtgccctaccttgcagagccctggcgtcatataactatttattaaataagcttcacggaacctcaacggggactctgttcacatgtaccagcagtgtgctccttctcctttctgcatccaagacatgatcctcagtaggaattgagaacaaaacccagctctttagccaaaaatggtttctgaggttcggttttcataaattcagaaagggggcttttttcccctccatctggccataggatattgttggcctctcttttatttattttattttatttttatttttatttttattttttgagatggaatctcactctgtcgcccagactggggtgcagtggcatgatctcggctcactgtaacctctgcctcctgggttcaagcaattctcctgcctcagccccctgagtagctgggattacaggtgtgcgccaccatgcttggctaatttttttgtatttttagtagagatgagttttcaccatgttgaccaggctggtctcgaactcctgacctcagatgatccacctgcctcagcctccaaagtactgagattacaggcatgagccatcgtgtccagccggcctctcttttagaagactctgtcccattgtcctttaagggcatgtcacttccctggaggtcaaaatcatgtcatactagtttttgcaatccacagctccttgcacaattcctggcccagggagtgggtacatcatcaatgtgtgaggaacagactgccatgaaatagtgtaaaaaatccacatagtacacttgtgagaaaagagataagaaccagaattttccaagcaaagggatagagagctacaaggtggaattcagcaggctcacacctattgggtgttagagagatgaacttagatcacatttatttaaacatctctgagtgcagtatttttaaagatcacacaagaataaaactgtagcactgaacttttctttaagtgttgaagtgaaggaaatgaagaactcagcacggaccctgcttagactccggcagaacaggtggtcttgacatgacgtcgctccaacatgcacgcaacttgccttttattctctcagctctttgtgccactagtacatggtcacctgggcatttctttagaaagggtgcagagactttcatttcgtgaaaatatagatgtcccagggaaaaataataatccaactggtataagtttatatcaaaccatatggaagtgattttttctggttagtcattttcacggggattagagagtagagaaaagtcaaagaaccagggattcccaaggacacacttggcctggtcaatattactaggattggcccagatgccaccaaatccttttttcttcctacttattgaaaaccctgttaaatttgatatgtgtaatatcttttctctaaaattttagccttgcaaataaaattttgcataacatttttattgacaagacattgtgtcacattaaggcttttgaaggtgatgaaatggacatgacatcttcaccttagcaagtaacactgaattaaagaagtttgtatttcagagtggaagagtacagtataaaatatttgaattcagacactttagagcttggaccctgtcagaagcttggaaatacttcgattttaaagctgctactcttccatttacctcactccaggaaatccttttagaaatcatactcttgagggaagaagacctaggggatagagcatgactccactgagaaatttaatttaggaaaataatgggggaaggggctgtagcctagaggctaaaaacccatgctctggagctagactgcctggcttcacatcccagccctaccaccttttaactagtgtactgaccttgggcaagttactcaacctctctgatcctgctgcttaatctgtacaatgggatgtgtggtagtattggccttgtagggttatttggagcattacttgagtcaataccagtgaaggcacatctttagcagaatgtgatgactgaacatgcactcaactggggactcgtttgttgtaaagattatccaggaaattgggaggagcaaggtagtcatcaccaagtataggacttgagggaggtttccagacctttgaggtccaaattgcaaggaggaggggaaggaaggatggccaggcaatagttgggagggaagtgaagtgaagaccccaggctatctgtcggtacctttgctggctgctgggaggggcagtgtctggactctggagaccacgcctccagagaccacaccctccaagaggccacacccttctagaggccacgccttcgtggaaaccacacccccccccttgctctgggccagttggcagcccctgctcttggggctggaccactccttcccagagaccatccattgtacaagaagcacggtctttgataggcttggaggaaaatccctcttccctctccggatccataaggactgcagagagcagccctcacacagcaaggctaattcctggaaacccttaagaaccccagatcagcttgattccaacacaaaggagtaatcaaggcggttgcaaaggaaacaatggcaagtgttttgtgaagcatttttttaagagagtgtgatggaaaattttctttttgaggaagaacatgttctccttgttggaaatgaagttgattttagttataattactaccaaagacaaaggttcattttcacacagacaatgtgatgaagccccaaacagtggaagtcagctctgatttcaaaatagacgcgtgaaggtatccgtgcctctgggtgagaacaaacttgtaggcctta

SEQ ID NO: 1117 - DNA, 3360 bp, Homo sapiens
acctttcaatgagttacatgtgcgttctaaataccagtatttttccttcatttgttgtcattaaaatatctctaagtgaatcaaatgtcacaagtaagtagaggaatttattgtgtatctactgattaaaatgtcccttcaagtccagttatagcagagggcctatttctgtttccaagatgatattgtagtttttcaacaggtatgtcatttagaatgtaacaaacgttatcttaaaaatctgtgcggtttaaaaattatttaaagggactgttgctttaatgctgatttttgtttgtttatttgtttaaaatgcagttaatgcttttactctattaagaccaagtgaaggccgagcgcagtggctcaggcctgtaatcccagcactttgggaggccgaggagggcggatcatggaggagggcggatcacgaggtcaggagatcgagatagagaccatcctggctaacacggtgaaaccctatctctactaaaaatacagaaaattagccgggtgtggtggcgggcacctgtagtcccagctacttgggaggctgaggcaggagaagggtgtgaacctgggaggcagaccttgcagtgagccgagatcgcaccactgcactccagcctgggtgacagagtgagactccgtctcaaaaaataaataaataaataaataaatatcaagtgaaaatatttatttcaagtaccagaatttaattatcattttcacctagctgttatctttctacgcaccatctccttatatcagtgcactgtgtcaaaatacaaccaggaactagccagcaagtgaaaagtacaagcgtcatccagtaagtagcagataaattgcatttgctttgccatgatctgggtaagaaagagctcagaaaaggaaatgcagcatattacaactttcatccccaacattaacttatttattattttgaaattatgtttcaattctgacacttccaattcaatcagacacgcactttttagacacgtgctatggtaggatcaatcaaatgcaattttagtcacttccctgtgcatatgcctagttccacagaacatgttacactgaaaataaactaatttaatacgctagtttaatttatcttaaacatttgctagtggtaactatataataggtaaactatatgtgatcaacacatatacacatagacacacacctacacacaaccagagtttaaacattacccagatacactatatgtcaaatttaatgtcattgatatccatataaatatgcacttatgttagaatatatggtatatctctcaacagatatatagataagtagataatacatacctatgtatgtcagagacataacaaaatataaatacattaacaatatttgataatttcaaaaaattagaaatttgaaaatttcaaaaattagaaatttggtttaagcacaaagatggtcctactcattttgtatcaaaaatgttttggcccaaaagcaaattttagcacatataaagttggtgctttccacaaaaaacaactgtagcctccaaaaattagtattttatgattaaatgaaaggagaaaattagacatttcccttcatgttcctgccaccatgaggagacaatctgaaaagcagaataaaggcaaggtggtcactttttaaaatctttgcacccattattgttttatctcccacccaaaatcaagtttcttatgctattcactttcttacactgaaggtctagcataggacatgattctagcaaaaatgtcaaacactgttgagcttaactgaccaagagagactaataggattttagcttttctgggaatgtcactccatagaaattttcatgtgtagtgtgatatgtccacaggagacaggtgggcatccagtacagtacctacaactgtggagtggctgcgggagggctagtggatagggaagacagtgtagaaaatgaacaagccctgtacaaagtagtctgatgtatgtttatttatttatttatttatttatttatttacttagaagccgtctcactccgtcgcccaggctggagtgcaataatgcaactatgcaacctctgctgcccaggtacaagcaattctcctgcctcagcctctggagtagctgggactacaggcatgtgctaccacgcccggttaattttggatttttagtagagacggggtttcaccattttggccaggctagtctcgaactcctgacctcaagtgatccgcctgctttggcctcccaaactaatgcatctttaaaaacaattcttaccagtaaggaaatttaattttaaagagacatacgtaaataattttgaaaaataagagtgttttgggaaggcagcaagttgatctttttttcccctgatctaatctgattcagagaccatgtacagataatattttcaataaaatatgttatcttctccaaacccaaataccaaaacctgttataaaatggaaatcaaactacagtaatataatttatccacaaaggcatatgacattttatttaaaacaaaaaaatagttaaaaattggagagggaaaaaacaatattttgtttacacaacaaagagaaaaatatttttacctagtctcaattaaatacaaccaaatatatcccattaatcaggggaagaaaaaggaaaagaaaacccctcctgctttgtccttccttcattccagcattcagtgaactgcttaaagttactgagacaacattaggtgcaatctgtagaagttattcatgggagttgaaagactgagttgtccttgggttagcagctctatttatgaagctttcagtgcatatgagtatgtagcagaataacctgagtttcattaaatagttatgtctatttttctcacattagtgattcagtaatgccttttggaaataaatggaaaaatgaaccacaaatgtcagtaatgtgaagtttcagctgaagatctttttgaaatacaaactgcaaacttgatcaattgtcttattttcagatgaggaaactgaggcttaaaaggctagaaggctatccaagttggcatcaatctctgatcaaaataatgtattggggacttcagtgttcagtgttctttcaattttgtgttaaaaaagaaaaaagaacaaggaacaaactctgccataggtccagggttatgaaatgctcttaagcaattacaaacgaagagcagcccactttttagcaacgtgacagaaaaggaactggagcttatttaaaggtgactccaactttaaaactatgttagcttcataataagttgattttcacagacagatataaaagtcctgagggggtaaaaattgcagtaatttc

SEQ ID NO: 1118 - DNA, 5796 bp, Homo sapiens
gaactatctccagatacaagaactctttcctacaagaactatcttgagaagaagcacactatgtatttttttcttcccattttgtactctttgaaaggctactccagaaaacagaaaagcaattttgcattggtaggcttacggctctcagatttacactactatttcatctgacccagattttataattaccctatttttctaaagttagacctactcttaaaatgaactgaatctagttcaattagaataatgagtagctagtaagtattctaactcctctaaaaattcatgtgtaagctatttttgcttctttctgaaacaatgtggcactcaatcatgggaacaccttataattattcatatatttttaattcttatgtcaaaagttgcaatttacatgtttcacttttgaacaagtttctatatgctttatcatcataacaattgatgatatttgtgcacactcatttggatctgtttatagaaccaaggtttctttggggacattgattttttttttttttttaaagagtgattcaaaatgttgaattttacttcctcgcttcatgggcttctttcccatttcttcaaatatttgttagaatttttagtgtccctctcatgttaatatgcaagaatagggcgtaatatgtttgtgttttcacattcctagggtttacctttgaggaaaacaatcactgagtattatctttgatcttaatgataatcctgaaaacatgacagcaatgcagagaaaataaataacttaaagaataggagcttagtagtctgcatattaacttggttcaatctcaaagctattactaagccaagtccctaacctctctctgtctcagtttcttaattttggaaactgacatctataaaggaaaggcgtgccataactataaattcttgagctttttttacccttaatatgtgtgatttgggacagacataaaagatggtcgattgttcctgacccctttctggctttctcctgttgcaatttttgatgccaggatattgttctctactttcagatacactgaaacactaatccattagtaaagagagtgttcactgcatcttctcgtacacagacatgcctcgaggattatatctacctaagttttgtacagatggtgctaaagcactggtagctgatagataaggctctttcaacagagcgggagtatgtgaaattcagtgtgaaaatatttgccactcagataatgactttttaaaataaatatgtgcttcagcttggaaattacaatgggggtcttaacttcactaacatgcatgattaagacttttcattacttaactatggtagtatgcaggatggtgaaataagcgaccaaagttagtgttgtttagatatttagactttgttatgaccctccctgagagaacatgaatgactcatattttaatctatcttggttttatctttcatacttgtggctaataaggagtgaggcctaagaatttggttctcaagtcagatttcagagagaattccagctcactcattttcaaacctgtgaccttgtgcaagttcctcaaccttgccaagtctcaagagttttattcgtaaaggacaatggtatctaccacattaaggttactgtaaataataaattgtattttagttaaagtgctaataatgggtcctagcatggagtaagtgatcaagtaaatactcattgtttttattaacattattataaataacatttcttattcttacattgaattgatggagctacacaatttaattgtcataacaaaggtaacagctaagaaggtagatagcaattgattggtcacatatttaagggaattaaatagtgctgagaccagcaggatcaaaggtattcagcagactggggcttcctttttcatgctgatatttacgttgcagttggatgtacacatcaggctttctctgtaaaattccttaactagaaaatatacacagcaggctagctaacctaggagttgtattttcacccatgaaagggtttctgtggtatctaacaacagcggctaccactatcaccaaagccaccacaacaatcagttaagatttaccagttcactttctggcaggccctcttataagagttttatatatagtaatgtgtttaattcccatatgcatcctagaaaataggtataattatttcctattaccataagttacctagaaaataggtaacattattctactttatcaataaatatctggaggcacagagtgactgcatgtctttcttcatgatcatgtctaatcctgtttgaatacctaatgaccttaacctcaaactttatctttgtttcagtaggaaatttgtcttcgtttttgatagcagttgctaagtagattcacaatcaaacagctgtttgtcattaggcaaaatgataacctttcaatgagttacatgtgcgttctaaataccagtatttttccttcatttgttgtcattaaaatatctctaagtgaatcaaatgtcacaagtaagtagaggaatttattgtgtatctactgattaaaatgtcccttcaagtccagttatagcagagggcctatttctgtttccaagatgatattgtagtttttcaacaggtatgtcatttagaatgtaacaaacgttatcttaaaaatctgtgcggtttaaaaattatttaaagggactgttgctttaatgctgatttttgtttgtttatttgtttaaaatgcagttaatgcttttactctattaagaccaagtgaaggccgagcgcagtggctcaggcctgtaatcccagcactttgggaggccgaggagggcggatcatggaggagggcggatcacgaggtcaggagatcgagatagagaccatcctggctaacacggtgaaaccctatctctactaaaaatacagaaaattagccgggtgtggtggcgggcacctgtagtcccagctacttgggaggctgaggcaggagaagggtgtgaacctgggaggcagaccttgcagtgagccgagatcgcaccactgcactccagcctgggtgacagagtgagactccgtctcaaaaaataaataaataaataaataaatatcaagtgaaaatatttatttcaagtaccagaatttaattatcattttcacctagctgttatctttctacgcaccatctccttatatcagtgcactgtgtcaaaatacaaccaggaactagccagcaagtgaaaagtacaagcgtcatccagtaagtagcagataaattgcatttgctttgccatgatctgggtaagaaagagctcagaaaaggaaatgcagcatattacaactttcatccccaacattaacttatttattattttgaaattatgtttcaattctgacacttccaattcaatcagacacgcactttttagacacgtgctatggtaggatcaatcaaatgcaattttagtcacttccctgtgcatatgcctagttccacagaacatgttacactgaaaataaactaatttaatacgctagtttaatttatcttaaacatttgctagtggtaactatataataggtaaactatatgtgatcaacacatatacacatagacacacacctacacacaaccagagtttaaacattacccagatacactatatgtcaaatttaatgtcattgatatccatataaatatgcacttatgttagaatatatggtatatctctcaacagatatatagataagtagataatacatacctatgtatgtcagagacataacaaaatataaatacattaacaatatttgataatttcaaaaaattagaaatttgaaaatttcaaaaattagaaatttggtttaagcacaaagatggtcctactcattttgtatcaaaaatgttttggcccaaaagcaaattttagcacatataaagttggtgctttccacaaaaaacaactgtagcctccaaaaattagtattttatgattaaatgaaaggagaaaattagacatttcccttcatgttcctgccaccatgaggagacaatctgaaaagcagaataaaggcaaggtggtcactttttaaaatctttgcacccattattgttttatctcccacccaaaatcaagtttcttatgctattcactttcttacactgaaggtctagcataggacatgattctagcaaaaatgtcaaacactgttgagcttaactgaccaagagagactaataggattttagcttttctgggaatgtcactccatagaaattttcatgtgtagtgtgatatgtccacaggagacaggtgggcatccagtacagtacctacaactgtggagtggctgcgggagggctagtggatagggaagacagtgtagaaaatgaacaagccctgtacaaagtagtctgatgtatgtttatttatttatttatttatttatttatttacttagaagccgtctcactccgtcgcccaggctggagtgcaataatgcaactatgcaacctctgctgcccaggtacaagcaattctcctgcctcagcctctggagtagctgggactacaggcatgtgctaccacgcccggttaattttggatttttagtagagacggggtttcaccattttggccaggctagtctcgaactcctgacctcaagtgatccgcctgctttggcctcccaaactaatgcatctttaaaaacaattcttaccagtaaggaaatttaattttaaagagacatacgtaaataattttgaaaaataagagtgttttgggaaggcagcaagttgatctttttttcccctgatctaatctgattcagagaccatgtacagataatattttcaataaaatatgttatcttctccaaacccaaataccaaaacctgttataaaatggaaatcaaactacagtaatataatttatccacaaaggcatatgacattttatttaaaacaaaaaaatagttaaaaattggagagggaaaaaacaatattttgtttacacaacaaagagaaaaatatttttacctagtctcaattaaatacaaccaaatatatcccattaatcaggggaagaaaaaggaaaagaaaacccctcctgctttgtccttccttcattccagcattcagtgaactgcttaaagttactgagacaacattaggtgcaatctgtagaagttattcatgggagttgaaagactgagttgtccttgggttagcagctctatttatgaagctttcagtgcatatgagtatgtagcagaataacctgagtttcattaaatagttatgtctatttttctcacattagtgattcagtaatgccttttggaaataaatggaaaaatgaaccacaaatgtcagtaatgtgaagtttcagctgaagatctttttgaaatacaaactgcaaacttgatcaattgtcttattttcagatgaggaaactgaggcttaaaaggctagaaggctatccaagttggcatcaatctctgatcaaaataatgtattggggacttcagtgttcagtgttctttcaattttgtgttaaaaaagaaaaaagaacaaggaacaaactctgccataggtccagggttatgaaatgctcttaagcaattacaaacgaagagcagcccactttttagcaacgtgacagaaaaggaactggagcttatttaaaggtgactccaactttaaaactatgttagcttcataataagttgattttcacagacagatataaaagtcctgagggggtaaaaattgcagtaatttc

SEQ ID NO: 1119 - DNA, 7408 bp, Homo sapiens
gaactatctccagatacaagaactctttcctacaagaactatcttgagaagaagcacactatgtatttttttcttcccattttgtactctttgaaaggctactccagaaaacagaaaagcaattttgcattggtaggcttacggctctcagatttacactactatttcatctgacccagattttataattaccctatttttctaaagttagacctactcttaaaatgaactgaatctagttcaattagaataatgagtagctagtaagtattctaactcctctaaaaattcatgtgtaagctatttttgcttctttctgaaacaatgtggcactcaatcatgggaacaccttataattattcatatatttttaattcttatgtcaaaagttgcaatttacatgtttcacttttgaacaagtttctatatgctttatcatcataacaattgatgatatttgtgcacactcatttggatctgtttatagaaccaaggtttctttggggacattgattttttttttttttttaaagagtgattcaaaatgttgaattttacttcctcgcttcatgggcttctttcccatttcttcaaatatttgttagaatttttagtgtccctctcatgttaatatgcaagaatagggcgtaatatgtttgtgttttcacattcctagggtttacctttgaggaaaacaatcactgagtattatctttgatcttaatgataatcctgaaaacatgacagcaatgcagagaaaataaataacttaaagaataggagcttagtagtctgcatattaacttggttcaatctcaaagctattactaagccaagtccctaacctctctctgtctcagtttcttaattttggaaactgacatctataaaggaaaggcgtgccataactataaattcttgagctttttttacccttaatatgtgtgatttgggacagacataaaagatggtcgattgttcctgacccctttctggctttctcctgttgcaatttttgatgccaggatattgttctctactttcagatacactgaaacactaatccattagtaaagagagtgttcactgcatcttctcgtacacagacatgcctcgaggattatatctacctaagttttgtacagatggtgctaaagcactggtagctgatagataaggctctttcaacagagcgggagtatgtgaaattcagtgtgaaaatatttgccactcagataatgactttttaaaataaatatgtgcttcagcttggaaattacaatgggggtcttaacttcactaacatgcatgattaagacttttcattacttaactatggtagtatgcaggatggtgaaataagcgaccaaagttagtgttgtttagatatttagactttgttatgaccctccctgagagaacatgaatgactcatattttaatctatcttggttttatctttcatacttgtggctaataaggagtgaggcctaagaatttggttctcaagtcagatttcagagagaattccagctcactcattttcaaacctgtgaccttgtgcaagttcctcaaccttgccaagtctcaagagttttattcgtaaaggacaatggtatctaccacattaaggttactgtaaataataaattgtattttagttaaagtgctaataatgggtcctagcatggagtaagtgatcaagtaaatactcattgtttttattaacattattataaataacatttcttattcttacattgaattgatggagctacacaatttaattgtcataacaaaggtaacagctaagaaggtagatagcaattgattggtcacatatttaagggaattaaatagtgctgagaccagcaggatcaaaggtattcagcagactggggcttcctttttcatgctgatatttacgttgcagttggatgtacacatcaggctttctctgtaaaattccttaactagaaaatatacacagcaggctagctaacctaggagttgtattttcacccatgaaagggtttctgtggtatctaacaacagcggctaccactatcaccaaagccaccacaacaatcagttaagatttaccagttcactttctggcaggccctcttataagagttttatatatagtaatgtgtttaattcccatatgcatcctagaaaataggtataattatttcctattaccataagttacctagaaaataggtaacattattctactttatcaataaatatctggaggcacagagtgactgcatgtctttcttcatgatcatgtctaatcctgtttgaatacctaatgaccttaacctcaaactttatctttgtttcagtaggaaatttgtcttcgtttttgatagcagttgctaagtagattcacaatcaaacagctgtttgtcattaggcaaaatgataacctttcaatgagttacatgtgcgttctaaataccagtatttttccttcatttgttgtcattaaaatatctctaagtgaatcaaatgtcacaagtaagtagaggaatttattgtgtatctactgattaaaatgtcccttcaagtccagttatagcagagggcctatttctgtttccaagatgatattgtagtttttcaacaggtatgtcatttagaatgtaacaaacgttatcttaaaaatctgtgcggtttaaaaattatttaaagggactgttgctttaatgctgatttttgtttgtttatttgtttaaaatgcagttaatgcttttactctattaagaccaagtgaaggccgagcgcagtggctcaggcctgtaatcccagcactttgggaggccgaggagggcggatcatggaggagggcggatcacgaggtcaggagatcgagatagagaccatcctggctaacacggtgaaaccctatctctactaaaaatacagaaaattagccgggtgtggtggcgggcacctgtagtcccagctacttgggaggctgaggcaggagaagggtgtgaacctgggaggcagaccttgcagtgagccgagatcgcaccactgcactccagcctgggtgacagagtgagactccgtctcaaaaaataaataaataaataaataaatatcaagtgaaaatatttatttcaagtaccagaatttaattatcattttcacctagctgttatctttctacgcaccatctccttatatcagtgcactgtgtcaaaatacaaccaggaactagccagcaagtgaaaagtacaagcgtcatccagtaagtagcagataaattgcatttgctttgccatgatctgggtaagaaagagctcagaaaaggaaatgcagcatattacaactttcatccccaacattaacttatttattattttgaaattatgtttcaattctgacacttccaattcaatcagacacgcactttttagacacgtgctatggtaggatcaatcaaatgcaattttagtcacttccctgtgcatatgcctagttccacagaacatgttacactgaaaataaactaatttaatacgctagtttaatttatcttaaacatttgctagtggtaactatataataggtaaactatatgtgatcaacacatatacacatagacacacacctacacacaaccagagtttaaacattacccagatacactatatgtcaaatttaatgtcattgatatccatataaatatgcacttatgttagaatatatggtatatctctcaacagatatatagataagtagataatacatacctatgtatgtcagagacataacaaaatataaatacattaacaatatttgataatttcaaaaaattagaaatttgaaaatttcaaaaattagaaatttggtttaagcacaaagatggtcctactcattttgtatcaaaaatgttttggcccaaaagcaaattttagcacatataaagttggtgctttccacaaaaaacaactgtagcctccaaaaattagtattttatgattaaatgaaaggagaaaattagacatttcccttcatgttcctgccaccatgaggagacaatctgaaaagcagaataaaggcaaggtggtcactttttaaaatctttgcacccattattgttttatctcccacccaaaatcaagtttcttatgctattcactttcttacactgaaggtctagcataggacatgattctagcaaaaatgtcaaacactgttgagcttaactgaccaagagagactaataggattttagcttttctgggaatgtcactccatagaaattttcatgtgtagtgtgatatgtccacaggagacaggtgggcatccagtacagtacctacaactgtggagtggctgcgggagggctagtggatagggaagacagtgtagaaaatgaacaagccctgtacaaagtagtctgatgtatgtttatttatttatttatttatttatttatttacttagaagccgtctcactccgtcgcccaggctggagtgcaataatgcaactatgcaacctctgctgcccaggtacaagcaattctcctgcctcagcctctggagtagctgggactacaggcatgtgctaccacgcccggttaattttggatttttagtagagacggggtttcaccattttggccaggctagtctcgaactcctgacctcaagtgatccgcctgctttggcctcccaaactaatgcatctttaaaaacaattcttaccagtaaggaaatttaattttaaagagacatacgtaaataattttgaaaaataagagtgttttgggaaggcagcaagttgatctttttttcccctgatctaatctgattcagagaccatgtacagataatattttcaataaaatatgttatcttctccaaacccaaataccaaaacctgttataaaatggaaatcaaactacagtaatataatttatccacaaaggcatatgacattttatttaaaacaaaaaaatagttaaaaattggagagggaaaaaacaatattttgtttacacaacaaagagaaaaatatttttacctagtctcaattaaatacaaccaaatatatcccattaatcaggggaagaaaaaggaaaagaaaacccctcctgctttgtccttccttcattccagcattcagtgaactgcttaaagttactgagacaacattaggtgcaatctgtagaagttattcatgggagttgaaagactgagttgtccttgggttagcagctctatttatgaagctttcagtgcatatgagtatgtagcagaataacctgagtttcattaaatagttatgtctatttttctcacattagtgattcagtaatgccttttggaaataaatggaaaaatgaaccacaaatgtcagtaatgtgaagtttcagctgaagatctttttgaaatacaaactgcaaacttgatcaattgtcttattttcagatgaggaaactgaggcttaaaaggctagaaggctatccaagttggcatcaatctctgatcaaaataatgtattggggacttcagtgttcagtgttctttcaattttgtgttaaaaaagaaaaaagaacaaggaacaaactctgccataggtccagggttatgaaatgctcttaagcaattacaaacgaagagcagcccactttttagcaacgtgacagaaaaggaactggagcttatttaaaggtgactccaactttaaaactatgttagcttcataataagttgattttcacagacagatataaaagtcctgagggggtaaaaattgcagtaatttcccccaatgatagcatttagaaagacactgaacaagttaactagaatcaataaacttgcaatgttcactactattttaaaaggaagtgatgaagatactttccgcatcagtctttcatgatcttgccgaaagttatctcaccataacttggggttaagagtttctacttcaagccagcagatgctgctaagaaaggcaatgcatgtctgctttatccaaaaaacttttcaatctcctgctagtttcaatgggggaaaagtagcactattattattattttattaggggaacctatcttcccatataccaagaaaatatctttgaactgataataacaaaatagtgacactaaatgatgtgtctagattaatcaatgcatcttcttttgtgtctccagcctcataagctcagtgaagtttcctccaccacttaattttacatttttctaaggaggcagacattagtataagtatataatataccatttagtatatgtatatgcatgtattatagatagattagacaaatatatgatagatatacgatagatagatagatagatagatagatagatagatgatttcctacagtctgtcctttcctcattgatctgcattgacatactatctattgttttggatataccaatgttcactattttaatatattattactttttgatcatgctcatcaattttaagctttgaaaaaaatttctccaagagagatgggataaccaaacaatttcatgtaaaatatttattacttgattatatttatgtgtgtgtgtatgatatatgtattatttttaatccactgaaaatatgttgtcttctgtttaaggtgaaaatccaaattgacttgctccacaaagagttagttatttgaaccagcacatttttttgtccttctttttcttacttcaacactcaggggaacacaatttttaaataattatttttccgacttgtaaggcctaccacatattaaattattacatatatgagattctatggctgagcacgctgttctgttttattgatgtttattttttcttgatctagttccatgtcacctaactgtcacagctttataatatattctaatgtgtgttaggctccttccaatcaaccaacccattaacattaattagcttacaatgtttatacgttataaacattataaacatctcatgtaatttcgcacgttttttccttatgaagatccgttaataaattaccaaaagatataatcagtttattcacttcaataaaaaaaagcaatcactgaatatttttaaatgaccataacttataaatttttttgtcttctgtattgacaaaataaatatacatcacaagttgctttgatctagctttctaaaacatagcaagttatacattcaaatttacttaaggggactttagaatagcccaaggaaattatatcttgctttgaattacattcctattattacaattatttgcaaagttataacgcataaatgagtttgacaattttatcatatcagagaatctggcctcatgccacaacaataatttattagttggaggatagatatacaactatagagatagattaaatcaggaaga

SEQ ID NO: 1120 - DNA, 65600 bp, Homo sapiens
ataataccacatggagacttctaaaagaaacccattgatagagtcctatagtcacccttgtgtacaaaaagtcatgtgaatactgcaaaaagaggcacatcttgtcatttcaatattaactctccaagaggtttttaaaacatctccaatatctatatgtaaaggttattcattaatattggctattatttggatgtgaatcctagaaaaaatatagacatttttaaagcaaagcatatgcaagtatttctatatgatacattaaggaatgtattgactgaaaatacaccaagataatgcatatctcgtaattcagattgaaggaacttattctaaggaaatgctatacaaatatgcacatacaagatgttcactgatgcagtgtcacaaatgcaaaaacctggattaaaaactaatagcctcagttatgttaatggaaagtgaaatactgtgaagccattaaaatgactctaatatctgaggagaaaaaacctcctcctcattttatagacaaagatggtcaattaaaaaataattaacgaaaaaattttccacttttggggaagccattttattgaatacactcacttatttaaacattcaagaaatactggacgtgtccgccagatttcatgtggttagaaacttcatccccaagctcatatattaattttaagtggggcatttgggaggtaactaggattagatgaggtcatcgcagaggggacaccctgataggactggtggtttcataggaagagaaggagatacgaatggacatgcatgctcttgtcctctaaccatgtgaggcagcaagaaggccctcaccagatgccggtggcatgctcttggactttccagcttctagaagcatgagcccaataaacttattttattaacagattatccagactgtggtattctattatagcaacagaaaatggactaagacatatactgaagagttgatgacaaaaataaatatgtgattttgacacattctatgaggaaaagaaaaagatgcagctcagaatcatagtattgaacctaacataggatgggggaaaaaagcagagaatgtgttgttaggatactatgggaaagtgagaacaggtacacgacaatttgcaactaagaatgttttggactcagagggagaatgcccctggcatcatgtcaaggctgggccacactgagttggggcagaggtggggagacagaactgaggaaaagtggagccaggccccagtgagctggctttaggattctgaattttgatttatttcagttcagtttatatactaaaaggtttgattcagttggttcattgaaaagatttaccagggaagaaatgacacaagtcatatgttttaatttagttatataacataatatagagttgtccctgaggatctgaggagggttggttccaggatgcccatggatacgacggtctgcagacactcaagtccttgatataaaatgacagagtatttgcatatagcctacacacatcctactgtatactttaaatcatctctagatgacttgtaatacctatgacaaggtaagagctgtgctaatacttttcatatttattttaaaatttgcattatgttttatatttattgttattttttactgcttttccaccaagtattttttatggattggttgaatctgcagatgcagaaccaagaatagagggcagactgtggtgacagacaccgtctgtgttatcacttgaagagctgtcctgtgggagaaatgacagcatgacaaacaggctatgtggacttcagcacatcggcacaatgtgcctccagttttttcatctggaaaaacaactggcagtgggtggtaagtgatattaatgtcccttccagttccaagtgcagtttagtgctttgggaatagtattcagagattctcttatggcagtgacatttttaccagtgttaggtgaataaaatataactttatgaaaaaaatggtataaaaggattagtatgttatttttcttatacaaaggaaactagctgaatgagaggcttaagggatatttgtcttttattatgtgaggtttttttgaaatttaaaatatgaagaaccaaaacttaccactaaatcctactgtccagattgcttttaaaagttctactgtgagaggtaaactgggaatctgagtgtgtttccagttgtgtaataattacattgccttattgttttttagccaggtaatattcttatctggaggcgatgtttaatattgtttgaatatctatgtgacttgcagcactatcataaatgagtcttacgacatgcctccgtcattctgatattgtggacaaatgatgttatagctatctacgaacattacatataaagaatgcatattgtcaagattgaattttacctgaggtctgagcccctggaaaacaatgaaaattaaagaaatactcctcatggccgggcgcagtggctgaagcctctaatcccagcactttgggaggccaaggcaggtggatcatgaggtcaggagttcgagactagcctggccaacatggcgaaaccctgtctctactaaaaaaatacaaaaactagcgcggtggctggtgcctgtaatcccagctactcggaaggctgaggcaggagaactgcttgaagccgggaggtggaggttgcagggagccgagattgcaccattgcactctagcctgggtgacagagcaagactctgtctcaaagaaagaaagaaagaaagagagagagagggagggaggaaaggagggaggaaagaaagaaaaagacggaaagaaagagagagaaagaaagaaagaaggaaaggaaggaaggaaggaaggaaggaaggaaggaaggaaggaaggaaggaagaaaggaagaaagaaagaaagaaagaaagaaagaaagaaagaaagaaagaaagaaagaaagaaagaaagaaactcctcacccttcagtgtgatcaaaaacagcttactgccaggtccccctttccccatatgaattagatgtgtcacctaacactggtaaaaatgtaactgctataagtgaatctctgaataatattctcaaagcactaaactgcacttggaactggaagggacattaatatcacttgtacccgttgactacataggacaaggccagacttccaattcctatcctttgcctcaacaatgattagctggattgcttgtccctactgatgaatcagaaatgcttattggttaaatttggtgaaggttctctctatcctcagaaccctgacctcaaccccagccagcagagagcctctcctgagaagaagctggccctagggtaaaaccctctctcatttactatcccatatgtctttcttccaccccactcctccacaccagttcttactagcttgtttattcccctgtataaaagaaagcccaagcttggtgtggtggctcacgcctgtatcctagcactttgggaggccgagatgggccgatcactggaggtcaggagtttgaaaccagcctggccaacatggtgaaactccatctctactaaaaatacaaaaaaaaaaaaaattaactgggcatgatggcacatgactgtaatcccagctactcaggaggctaaggcaggagcatcgcttgaacctgggacgcagaggttgcagtgagccgagattgcaccattgcactccgcctgggtgacaagagagaaactccatttcgaaaaaagaaagaaagagagagagagggacagagagagagagaaagaaaggagaggaaggaaggaaagagagagaaagaatgggagagagagagagagaaggagggaaggaaggaaggaaggagagagaaagaagaaagaaaagaaaagaaaagaaaagccccttttgcctaacccttgagatgcctgcagatcttatggtcagagcattcttctattgcacccatcctcctcccactattcgaatagcccatccctaagcccctgcaataatcctttctaataacgtctactcttactaaattgagatttattttttatttgacagggtttttaatgagaaatgctttttacgaggttagaatagttctggtggttgttccttagtctctcatcacatctcctttatgacttggaaagataaatttagcatggaaaaaaatgtgattattagaaaacaaaaagaattttaaatcatgaaagaaatttatgcaaacaatagggcaagacctagtacataaaaagagtcagtgaagcgaataaaaacaacaacaaaacagcaccaccaccaccacttaaccacaaagtgaaacaatttacataatgatttcttgcttttcttcttcatattattgaaagtttctttgttcatgttatctccagtggtctgttaaatgtttgcaatgcctcagtgctcctctgaacaactttgttaggaatgagaagtgctctacctatcaacaacaaaggcagccgaatggctagaaataagtttgttgaaaatacttcttgggttctgccttacctgtcaatcacaaaaagaaggtggagaaaggaggcatgcttatggcatcccagttttaaggaagaacattttagcaataagcaagcagtcaccaaaaggattcaaaaaggcagtgggtttagggtgctttgtttcactgtgaacatgaactgtcataaatgcatatctgatattttaatatcagatatttggttaaaaaaaaaaaagtgaggtaggagggtgcatttcattatctctcccagatacgtactggccatctggtgggaaagaaaacaggcagtctcagtccagggaccagaggatctcctttgtccctgtacatacacgcaagaacgcacatattacattatccaggtagagagcacgtggtaggttacaaagaagccatgaggaagaaataggaaacctgaattgtagttgcactcctctcaatatcctcatcagcaaaatgaatgagttgttaataattacaattgtaccaactgtcatactttgccatatggcttgtatatgtgtttggtattttaaatctataacatacagtcatgtgccccatctgcatcaatcatggcatgtgtatatggtggtattttgtattttaccctactttttaatgtttagatacaaaaatactctccattgtgttacagttgcctgcagtattcagtacagaaacatgctgcatgggtttgttgtctaggggcaataggctacaccgtacagcccaggtgtgcagtaggctataccatctagatttgtgtaagtatactctatgttgtttgcacaacaagaagattgtctaaccatgtgtttttcagaagtatgttgtcattaagtgacacgtgactatacataaatatgttaatagcttgtaatgaagacataagctctaattctgatcaagcctagacaaagcaacttacatacataattcttaaaataaaaacccaaggaagacgttagtattccttgtttctggaaaaggagccaagaccctgggagttaagtggccttctatgaggccagatgactgggccaggacccactacctggctgaccccaaagttcacccttttattcattctgctgcattggttgtgacctagaatattctgttgtttttctggtttagagaaacagaaagaagactcagagtagactctgaaatgtccactccccacacattgcccagagccactggaggtacaatgtgccaggcacagctgtgtgggcagcaaggcacgtggagcaggaagcaaaggatgatgccgaggcacgggccacgtgtgcagtgcccgaagggggtctcctctggtcgtggctgtgcaccagtgacagaagggtttacttactatgatactggagaccaccatgatcactgacatttccttaatgatgcacaaaatgaagcgcacaagtatccaacaaatgaccagagaaaacgctagcatacttctctgaatgtacacttcagagaaggagggaaatgcttaaatgtaatattttagataaatcactgaatacaattagtatagtaagtacactatggatttgatggtatgtagtaatacgtctctatggcaagctcatctcctggaaaactggaactacatttgtccacaagcctttctcactgagcaggaacacagcttgcaggttggccgactcatctccccagattttattttctattttatctatatttttcctggctctaatttgtttctgttttgttacattttatagattcctacaaacctctttaactattttgtaatgcaagatatttgagcataaatccctaaaagacatattattttatgatgtaaaggtttcattttttccattttatagatgattaaatagaggcccggcatggttaagcggcaagcccagagtcagccatccaacgcagcgcagagctgtgatacaacccacttccactcccacggcatctcggcttcgtgggagttgaggagcgtctcaactgcatgtcaggagaacccatgaaaaggaaagaacccagaacaaatgggtgagaaagttcaagactatgttcagcgtaagagcaaaagcctcctgagaattctgcttgcagcccattcccaggcattacagtgcaaagctaattagggagaatggcatgagtagaagaccaccaagaccaccagctgaaacgggtgttctcatggcctccagtgggctcgactatttttatatttttaatattttggtccaatcactactctatacaacttagctgtcttaaaacaataaagccaaaacaaaaataaaacaataacccaggcctcccagatgttggcttcagtctgtgttcacaagttatcttcctaatataacagcatgagtactacttccccatactgttctcatgagatctatggccaggtccaaggtcacatcatagtaaatctttatgaaggttaagaaatttataacatttgcatttgttcacgaatgtcaataatcccaaccggcaggttttacgctcaggtttgaatgacactttgctaaccaagccattaaggtttgtttcaaggagtcgggggaagctccccagcagctctgagcaaatgaggagccagagaaaaacaattaaaaattttttaaaataagatctttgaaagtatattattaattctatcatccaataagtgttttcgaagactatgcaaatgacatcttgcggtataaaagctgttacagaacagaccttccaacatttctcagtctccttctttccttcccacgcatgccctatgtgtggactggcagcaatgtttttacttttaagaggaatttcatcatttgggaaaaatttagagatattaacgaaaaattgctatgtgtctcatggctacctactgattagaagcaattaacttatttctattttgaaaaattaggctagcaaatgaagcctgtgggagaagcatatttaataaatatagaaatattaattgtaggaagtaacaataacaccatgcaaagttgtcctgtacattgaaaaatcatactgattgtttacctccttattcacagcaagggaatcaagaccatagaagtcaacctgtagctgtataattgcgtccaaatcccagtgaagagtaaatgctaaagcattagggtgaacccattaaaactgagaaaagagagggaaataaatcaatacttaagagtagagttacctaccaaagtaccattcagttcaacacatttggaggcctctttttcatatatgatgagttttcactcatatacactgataaaaaggtgaagcataaaacatctagaatgatgttttgaagaaggtgaaagaatcactgtggtgaagactatagaactgccctgcctccatctctcctaggcactttagccattttactctaaagcagatttggagttgactttttaaatttcctttcaatgttagaaatttaaattagaaaatgtatgttaaagttgattaaaacttaacaagttattctgacccattttcctcttctactgcaattctgtctaatgtcttttatgatgcctttacaattactgttatcatcatcattattattttagtctatcatgtaggaaaatataactggattttgatttccttaagaggttttctacattatttagatttgtgaaagaatgttattgtaagtaaatagcaccaaatcttaaggatacaatatataactgctaacgcaaacagtatttgagaaatgcatctagatattcattactttattaaaaaagacatagaattggcataataaattgctagataaagcaattgagtaaagtgtaatgagttcaagtagagataagatcattttatggagataaatgaattagagaggttgtgattgagaagtgagaagtggttaaagtgttttaagacaaattataatatctaggtcttatccctacttatattgataggcatgatttggtgggaaaaaaagaaacattgtcactttaagtatttccctatcctaaatgaaagctactttattcaagagtataagctaccctaagtttctttattttaaactttgaatgcttcatcacacaaatgtttatattttaatagaaatgtattatgtctgatgatatccaacatatatatacaggctattgaattctatatgtagtaataatcatgaaactcagtgttttctcaattatatcagcaaattctctaacacagatatgccaggttttcttcaactttgatgaagtcactttagttctagtaaagtagaattccttctagaaggaatttaaaagaagctgaatttcctggcttccccccacccccaacaagcacctatataatttatcagtccatatttcaaactactttatttattcaattacaacacattccatggataattctaaaataaactcccacatttaaaattaaggagccacaaaagacacttttaaaataagaaattgcataaagagagaagaaaaaataaaatttttcacaacctacaaattaccaccaagttttacattgagtttgacattcctggtattcagagcaaaatatggacacaaagactcatgcacacactgggtgacctcatttcactgttgtatgtgtgattcctcattctaagtatagaatccaggaggtgcgggtccctttgtccccaccaggaaaatgcagttttccacagtgttaaggttggttacctttttccaatggcagaaaatgcaggccagaaactgagaaagttgctcagttcatacagaaagcagactgcctaacatgaacctcttagtagtcagagcgacatatgctattgaagtaatgtgttcctttattttctaaatggatccttcccaagtaaaatgtacctaagtacataaaccatttagtgggaatacatacacaaagagttgcctcctagatgtaaatgcctcttgaacaacaatcaactattaactcatgcaaaaatattttgataacattttcacaattatctgctaaattaaaggaaactactcacagcaacaaatgccatcaacatctggcagtgaaacaactttgaggtacatctggacaaaaatgactcatgtctaccctcacctgttgcaggctttacacctacagagaggcagctcctctttgccccaacatatttagtttctggactgcattttcgccttctgttgcaaaatggcaatcaaccttattaccgtagaaaactgcatcttcatggtaaggacaaaggggtctgtacattctggaattatattcaacacttacatttacatgaaagagccttgaaaacaatagaataattagacatgtttgtgagataattatgtcatgtaatgatgcctattacccaaagagctgttggttccttaaaaaaaaaaaaacatttatcagccaatcttgcagacttgtaggatctgaagaacagcactgttctcatcagagctaaaagcatatgctatgaatggggtcctccacatggcaatgaccgcaataaattaccagtgtgtgttctgttttcttgagatgggctcaatttatcattttattgaaaaggttccattatgctaatgtcttacaaaatcacattctgctgttgctggaaggtcatgaggggatataaatttttgcatttagaactaagaagttgtatagcagtcacagactccaagggttaataagaagccatcaaattacattcaaggacttatcaatgacagctcttcagcatgctctcctagttaacaaaagagaaaaaggggaatattgttccaagcttaacatcacacacacaaaaatgcttcaagtataaacgtattaaaacttggttttaacacaggttgatcatttgaaaaaaaagtcattgaaattttatctgtcagtgtgaagtatcagtataacaggtacatttaatacgagtttaatagaggtttctagtacatagtactcagtttgtttaaattagctactatcttcaaagactttcaaagataagtttgctgaagatctacaaagaatgcaaaaattaatatgcatattttagtgtaacctcattgtgtctataaggaggataatggagatttttgactagcatcaaatcccacatctcagtgagttcttagggaaaagaaagatgatgagctaattattcaatgcaaattagatattattccttagagaaatgttttgtttccatcttttcaagaattactgtttccttccaatcatgaaggactgtggatgtaattcacgaatatatggtgccatcaatctatcaataatttgcagttatgggcaacaactgtcaaacagctgagtaaaaacacataaaaccagatagctccctttggaccaattattgtaaaccatagaaacactgaggaaaaacagttgctctttagaaacacttggtatatacttggcatccaattttgtaatgcaacctaacaagcagaatgtaaacaacagtaactgcattgctagatttgtcattctgttttgtctggttcagcagctaagtggttacgaatattaacattctacaacatcagtgtaccttaaattcaagaggccattttgaatggatcactgattgcattttgatggaattcccagggaggtgatgagtaagaagccaggttgtggtctagggctgggcacattcaatcttattctgtattaaagtacagagatggagatacacaatatgctctttcctcacctggaactaatttgacagggaaaaaaaaagctttagaaatgggtctaagatagtttggaaacccaagttcacaaaattgtgtttaaaaatatataaaaggattatagaacttcttgacaaattcaaattattatataaagtttctcattgagtagctccaaacactgtcaaaattattttttctgtcagttatgtatgtcctgtcaacaggtatatgcattcacgccaaatgaacaggccatggaaagtagacatctctttatttgggaaaccattactcaaagattttaccaaaaaaataaaaaaagatttttggaagagcttggggtgaagtggttgtttttgcatcagggtatatggaattaatgttgattcttccaaatcatgatgactctaatgaatctaatcaagtacacataaacactttgatctaattcaaagaatatggaattttgaatcaaaagacagtggttccaatcttagcctcaatatcttttagctatgacagtttggccaacaatttcatctttactctcagttctccataaaagaaggaatgataattatggccctaagagataatgtaagtgtaaatgtttcacaaactgttagaagaaagggaaatacttattattctcttgagcgtaaaatattgtatctctctggtgatgtaatggttgcagggagcaaagtatatttaccaaaacattttacatattaaataggactattttagtttcattctcttaataatcaaaaaaaatttgaaacttagaattaaaccaaagagattactggtactctttcaatgcgatgtaggtttattatatgggctattttacaactcggtaggagcagtggttcacttttttccagtggaaatacaaagaatttctgtccagtggagcagacaacctcaaatattatggtttattgccctgtaaacacttgacaagatttgtatctagtctagcaatcttatgctaacatctctttattaaattgcatatttacctatctataatcaagacactaatttttccaaagccttttgaaccaatttatacagcttgctgcttctcacattaagtaataggttgaagaaaatttttgacacttgtacattttatatctaatataatatctaatataatataatataaaatagcaaaacagctattttaccttactggaaattataatttaatggttttagaggtcacgctcaaatggaccaaataaccttcatttccaggaagtttgcctcatggactaatatactaaggaatagttcctgaagtcagacagatcttgaaatctgcaaccggggttctccactttttcccctttttcttttctgaatttgtgtgtttggttttgcttggagcacagactcacaataatctatttccctttggtggtcacagtgattgggaattgccttgatagtctgactggcaatctctggacctggatgacacagctttattctttgttgaataagagacaacagagactatgtgtaagtcacttgtgtttacttatctcttggtgacctcagatcaattaaaaatcatatgcccactggggaggaaaacagctctttgaggtctggactaatacatttttgtgattctctatcttcttttgacgcatgactgaagttgtaggactgaagctataaattctctacatggctttgcgtctacatatctgtaattcacaaaagctgttgcctccgttgtgtgaaatgtttccctgcttgttgcaggctgaattacgtcaaaattcctatgttgaagctctaacccccagcacctcctaatccaactgtatttgattaattataatgaggtctttcgggtgagccctcatgcaatctgactactgtccttataggaagaggaaatttacacaccagacaagagggtatgtagaggaaaccccgtgagaggaaacggagaagacggccatctgtacaccaaagagacatgcctagaaagaaagcaaacctacaacaccttgatcttggacatttggcctccagaaccacaaaaaatagattttggttgttgaagaaaaataaataatgacatatacaaatggaataccggcaaaattcacagaaaataaagcaaactctgagtacttcaagtgttctagatttttagggaaaaatctcctcttatagaaactgcttgctcagaaatccaatcacatacatatggtgaatctttggacaatggaacagttttaataatttgggtttaagaaaggaaaaacttttctctcatttttcagtgttaaatatgtgataaggtttctattttacattttaacaggttggggtttggtttcccaggaaaagcgtacttaatccgaacttctcgtacttctcaaactatttttcaatcacaaaatcttgcattacagtgacataattttaaagttttttgaaaaatatacatttttagctgactaaatagaataataattctggcaagtttttctgtagtaggttcttatatctttatatataacttgcaaacatggattgatcttcagacagctaggtaatttgtattaaggctgaaaacaaaagcaatgataaacagacataatatttagtttacatatttttggccctttagttatacatactatagaatggctatatttttgagtcacattaattgttttagttttgctactttaggagcctgtagctctaaaaattgtactatatatatttatagctttgttagtctgctaaaatgtttgtgtttgacacacagctctcctattatgactttccagtttctttgtgaaatcaaagatcttattttgaatacaagttataatcggatttggtggctgagacttaaatagaagaaacagtaacagaaaaatacaacgatttatccaaagtaatgggatgagctttctttttcaagaatgaaaagaatagggtattttttccctaaagcaaagtgttgttttgtaccagtatatgaaatgacaccgtgaaagataaaacttgagagaacacagcaagttgtggaaaatttgagggaagtgaattttaactgcttttgtttataacacctatgtctgaaaagaagctataaaatatattaaaattcacctaattttgattggcttatttgtgagataaattaagggggaaaatgatctcataaaacctatatttccaatgcattaatgcaaaattaaaagtagtctttttcttagttgaattaataaattcatcttagaattcttaccaaggcatagtaaaaatactatttttcccttttgtgtgatatgaccagaaagcagagattttataacccaccagaataatctctgctttgtgttgattctagcatagtgttagaaaataaaaatctacaattatgaaaggcaaagtttcctcacttgtgaatgaaccaagattccctgcaatcatattacatttaccaacaattatttttgaacacttgttaatttgattaaatcgataattaaaggcacctaggattttattatagccaaacgaccaagtctactctgacaactactttaatttccccccagccccatgatcagatctaaaatttaaaaatatagaccataaaaattcaacaatatactttatacttaaaactggctttaaaatctcccacaggctccctggagagaggagctggaaagccttaggtttgtttcaagggttttgtatttcttaatcacctccccactacagaagagctatggaatgagctgtcaaatcagaaggacgctcagccttccctgggttcagtttgtgtacatgaaatgttatgcacagaaatctgttactaatcgaacattttatgggaagaccaaggagagtcatcagagcccatgctgtccattatatatatgttcttactctccggagaaacattgatcaaactcttataaaatagtcatacactgtgtcacaaagggttattttacactcgtcattctgatattgctggtcactgtagtaattaatccagccttttattagtatcaaactggtttctgtctccatctgatgcttgcctgagaactgtgctataaaccacaggcctggggttgtatcttcagcgtatactcctgtttccagacttctcagaaaggagtgtgccagatactctgaactactgatacttcaaagaatagactcttgggtactggcgttagagctgacatcagctcaacaactttcagactgtaccagggaatgaatcagaatttccaggacttattttagtctggaaatagatgttcttcatgaaactagcacctaacccaagatccaaaaaataacaattaattacacaagaacaaatgaactgatgagttaaattatggctacttattttgaatgtttttagtattgcatttaatgttaatttttatggatatatgaagttctctttcttcttcatcagtatcactttggatataatagactattgcttttgtatataattttttttttttttaagacagagtcttgctctgtcaccaggctggagtgcagtggcatgatctcggctcactgccacctccaccttccaggttcagtggattctcctgcctcagcctcccgagtacctgggactacaggtgcaccaccaccacacccagctaatttttgtatttttagtagagacgaggtttcaccatgttggccaggatggtctcgatctcttgacctcgtgatcagcccgccttggcctcccaaagggctgggattacaggcgtgagccaccagctgcttttgcatataaaatttaaaaaactgtaagtagtatctgatttttagcatccttcgaaaggcagaaagaaatacttttactgattctccttactttttcatgagaacatagttattaacataggttcaattaggatttgttctcatcttaccaggatacaattgaacaaattgattatgcaacaaaggatacacatggagaattatatatgagaataaatctcacttcatcaaacacagcggcacgctagtccggaaaactgacgagacacgtagctagtgcctacgaagcccagtggacaaatcaggtttactacctggctattagagtcctgttcctgagaacttcaagaagaaaggaattcatcccaatttatatatacagtgcaggcaaaatatggtggagagaatgtcttggaattgtttcccgagctttgagaaagaaaagcaaataataaaggcttttaaaagtcaaatctaagattccttaaaaaaaaatctcaggcagaattaattatctgggtcaaattatatggctatagatttgtaaagcaaactcaagcaggcctatctggttaattaacagtctcattggaactatgtaaaaaataaggccatgtttcatctggatgaaaatagcatttttctgtgattaaaacaaaacaaaacaaaacaaaacgaaacctttgtgggctaggtgcagtgtttaacgcctgtaatccagcactttgggaggccgaggcagagggatcaccttgaagtcaggagtttcagaccatcctggccaacaggtcgaaatcctgtctctactaaaaatacaaaagttagccgggcatggttgcaggcgcctgtactcccagctactccggaggctgaggcaggagaatcgcttgagcccaggacgcagaggttgcagtgagccgagatcacaccacaggactccagcctgggttacaacagagcaagactccgtctcaaaaacaaacaaatgaaaaccgttttgattatttataagggggggggcagggaatggagtgtaaaaaaatagccacaacttagaaatgggccaaatagacaactagatgtccttttggtgcagcgttgagcttgttttcctattggcagggagctgtaccactttgtagaggctgagataccttgtacatttttgtttggtaaagatttccatccagtgtaacagataaccccaaagtcaatggtttaatatcctcccatttatttatctctctcacacacacacacatgctagaaagaacttttcctttgatcctttgatgagtacacagaagtacagagagttgtataatgagtaaccatcccccagattcaattataaataatgtgtaactagctggttgtcccacttccactgatcctaagattgatcacatggcatcagccagattcccttcacttatatcaacccattcactttcatctaattgtttcatctatttatatctgttggcagaataaagtaggacttgcaaaatggtgaatatctaatttcgcaatgcatctccaattattgtctgaaacttctctgtaaagaaaaattttcctcaactactagggctatttggttaccttgaaatagaattcttacaggaaaagctagataaacccttattttatttttttaattatcaatttcctgagtttgattttagggctctagttatttccaggagtttctaatgtatttgggttttttagcaaaattatgacttgttaagtcttcaataacttttttgtcttagattacacttgttttcatcttggattatcccatcttgggacactgaatcttcattagcccctgtgtccttcaagtatgtcccttctgatttcataatctccactagctttcaaataagatagccacacaagatacacaaggttcatcttgcatatgatttgtcccaggcctaaaatcttctattcttcaatgattccttgtcttttttagttaaaaacagtattaagagaccacaatctgagtggccacaaacgtactcctagttaataggtttagatgaatgatccagacactctacctgaaaagaggggagagtgggaggatcaggagacaggaaaacactagtacatgaagtgttaaaactggctgctcatcagaatcacctgtgaaaccttcaacatagagattctcaggcctcaaccattatggaatatgatgatcaaaggggagcccaggttatgtaaaaggccctaaggaaatgaagtcactccggggcccactaggcgggagtgctgagttacagtctccaagcagccacatttccagaccttgggatccagtatattagatatgcttagcagttgaagaatttctttcttatcttaaatagtaatacatattcattctagaaagttcatataaaccaaatattcgaaataaaaataagtcacaatcccatcacaagaagaaactgctattaaatcttgcatctgcattttaatattcttctttatgtatgcacatgcataaacggggatatatatggttagttattttttatagagtaagatcacaaactactcagtaatttggaattgaattttgtcatgtggtgtctttccatgccattaaataatattctcaacatcatcttcaatggatccatagtgtttcattttatagaactgccaaacattcagaacctatggttgtacctcttgatagttttccattttttactaatataaacagtgttgaacatccttctagataatctactgtgtatatctgtaatataattttatcataaactctgagagtataaatgactaagtcaaaaggtcgaaattgcattttctcttgtgagaattctaaaataattccctatcagtttaaagtaagaaaagtctagggcacatgaaaagaactagaaatgaagaagcaagtgtgcataaagagggaaggaaacatgctgactcttatcttttagagctgtcacacattgaattttaatgtttggggaaataaccaatgtagctgttaggaagctgtgattcaaacatggtagcactaaacgatacatcactgtattgggggcaggtgcaacataaacctcccatggatatttgtcaggtgaagaattcaggaataaggtttgcctatctgtatatagaattttgaagtcagggtaccttctagtgttgactgcaatggttaagtcatctgtctgtctctgacaaaagagctagaccctgcttcaggaatgcaaacttctcccactgctatggtctgactgtttctgtccccaaataattcagatgttgaaacctaatcaccaatgtgatggcattcagacataagaaatttggaggtgattaggtcatgagtatggagccaccgtgaatgggatacgtgctcttacagaagatgccctggagagctgctgtgctccctccaccatgagagggcacggctggaaggcaccatctatgaaccagcaagcagccttcggctgacatcagctttaaaggtgccttgttctttcacttcccagcatctagaactggaagaaataaatatctgttgcttataagccactgactcattttgtattttgtcatagcagcccaaaggggctaagacacccacaattgggaatcttggatgagaatgaactatatttcccattttcaaaaagcttatcaatgagtgaataaacaaatgttgttttcattcatttaacacatattattaagttagtaagcatcaacaatgtgcccagcactgtgttaggtactgcaacagcccagagtgagaggaaatgcccctgcttcctggagcctgccttccagcgggcagcctaccacctgcgtgtgctattctggtggccaggacgctgttgtctacagtaacctggtaaattaactatgttaagagagtactttttctttcttcacagaaacaagaaaaattatttgccgtggagtccaagagaggagcatatctatcgaaatggtaattgaaagagaaactggaaacatcacctgtatgaaaaatagtggatggctctgttaacgaaacaggcatgctggtgacaacaggcaacaaatctaatctaatctaatctaatctaatctaatctaatctgtttctccataataagcagcaatcatacaacccactaaatgactgctgttgcttgtcactgaagatgtccatattttactgggacataacatttcttcttggcatgaagagaatggattaagcaaatgaataaaagctatggttctactttaccagcacaaatggacaaatccaaaataaataactgttacagcaactatgctaaccgtattaattaaaatatgcaaggtatactcattctcattttcataaaaggaaatcctaaacgctcaatttgaagtatgtttcctcactatttgtaggaacttctagtcctagaattcttggtccacctttccccaagattgtattcatttgttaaatatgagacaccaccaaaattgtaatgatgccacaatgggagagttaatgaagtaaaaaaatattaaatgagtcaactattattaaaaaagaggcaacttcatatccatcaattagaaatcaaagagtctggctggctatttatcatcaaaaatcttttattggtataaaaaagtccacacaataagcagctttttaaaataaccactcaggccagagtatcactcaccaagctgtgactttatgttctttgtaacaataaagaaattacatggcaaacaacaatctgtgaaaactttcaaatcatactttcctaagctatcgctctagattaaaatgtttgccttagttttcagggggttagagaagagtgtcttatctccaaacagaacaacttcatgaagatgcatacacactttcttcttgcagctaaggaaggaccgtctttgactaggtaaagatccatgtatttgaatcatgaaaatatccaaaaagacgggctgggcatggcggctcacatctgtaatcccaaatactgggaggctgaggtgggcagatcatgaggtcaggagtttgccaccagtctggctaacatggtaaaaccctgtctctattaaaaatacaaaaattagctgggcatggtggtgggtgcctgtaatcccagcttctctggaggctgagggaggagaattgctttaatctgagaagtgggggttgcattgagctgagatggcacctttgactccagcctgggtgatagggtgggactccatctcaaaaaaaaaaaaaaaggaaatatccaaaaagacacattagcaggactcagttcccagtgtgttgtttgaggcactgaccctgatctgaaaacagtgctcagttgattcaatctgaatctgtgtccaccgtcttcctgctcacttagaataagagctgtgtttgcattgcacaatgaacacccacttgctgaaagctaacttgttcctaactgcccccatccttcatccactgccagagccagctttgttaagccccctgtgacctatatctgtgacctatccctagctaatcttctctttcaaaatatgaagtggggtacacactcatcgccaaagggtcctttgagcaagtcccagtagaaaatttatccactttttggatgaagtactcaaaaaagagtactacatttcccaacataaaatggaaaacaaatacatatgccatacatcattcagggctggaaaacaacgaaaatgtaacactccagaaaaacagccatgggaagtattattcctcatgccatccatcattatcatagagcacccactattctaatttagctccaaatgtgtggtggaggtgatcaaactttaaaattaagtaaacaaagagattcatacaaaaataaaataaaataaaataaaataaaataaaataaaataaaataaaataaaaaccctgaccccaaaactagagtaacctgacgtctcccaagtatgggttggggacctagcacctgttctgggggcaattcaggcaggtagccctggatctgtaaacctaggtagtattttagagcctgagcacaatattgggcctttgtacatgtgaactagaaagcaaagggataactgaaatggataacagatagtcagcacttggtatattccaggcctttctctaggcccttgtcacgaagtatctgacatcaacttcatgagttaggtactttttccttatctctgtatgagaaatggggaaactgtggcctggtatgtttaaaaacaaaacaaaacagtgcactattcacttgaggatcttattaaaatgaaggttactgattcagtaggtctgatagggggccaatgattctgcatttctgataaactcccaattgctgctgctggcccacagatcacactttggactgcaagaaagtaaattctccgagtcctagaggtagcaagaagtagagccaagacgggctaagttgcttggctccggggcccacacttactgccagtcggcttagcatttgcatggcagacacatcacagcccaggtaccatgaatgcgctcaaggattcaaaatcaatgtctgtcaccctttttgactgcattttctagcaacaaaaattctgtattcagtgcgtagtatataccaggaactgtggtaaacactggttcaaacgattttcatttaatccactgaagtaaattatcggccatttgattcccttcttacaggaagcaaatcacaaccccactgatgcactgggactctagtgagtttaattatcatgcacagaaaagattgagcattaatttgcaaagaattagaatctaataacacacctctaacaccaaaggtagtcaacctttggggattgaggaagaattgtaagatcttacagagcatcagaggtatcatttggaaaattaattatagtcaaatagatgaagaaggtgtaggagtttgggcctgattctgtgaaattatcaaaaagtactctaaaaaagaatgtagtgatattttccttgtcataagggtttcattttctattatataatagatattttattaattctgtttttcttacataagtagaccataaattcttgatttatgtatgaaatgtttggaagctacaggtcatacaaaataacaccttctataaaatttcacaaaatttccattagtccttatttactcagaacaaatttagaaagattgaaaagagtgtattacagacagttaaattctaccacttaatttgaaattttttctttatcttccctttaagaaagtggaatccagcagcctgcctgcatttttggcagactctgcaataattacgatgctcagatgattcccaagatggacctccccagctgtaaataccctgcctccacgctcattcctgtcaagtgcagatctccccatcttggcatatgggcagtgtcctctgaaacacttcagggtttgaagagtaaaagatgtaaatgatttgcttcactggccatgtaggcctccaggagagggacacccagacactaccatttgtagaggcctgtcgttagaagagcacactgtccagccaggcctcatggagtcttgaatgcaatgtctcccttccccttgaaatcacaatatgaccttgcagaggtgacttcagaaaaatcaaaacattttgaggctccctacaagtactttacttaacttcaacaaccaatgctgtcatttctcacctactctcccccacagttactttttatttctttatgtttcaaaacagataaccaaccacaaaaagcaaaacaattcccacagaggcatgaacccaaacaggcacgaacaaaagcacaaggtagacggggccagcctcagcctgtgctgccccggcatggtattcctctccgcagctttttgtcaattgcatgctgacactccttcccgctctatttcatgacatgtctcctctccttttggaagcatataagcaaaaacatggggctgggtgtggtggctcacacctgtaatcccagcacttcaagaggccggggtcagtggattacctgaggtcagtagttccagaccagactggccagcgtggccacagtttttcttttttttttctcaaaagcaaaaaattctgaaaaagtagtataccttgtgatatagttttaaaatctgactacttggctgaaatcaattaacatgactcttcaaaaaggtccattttaagactatatctactttctaaccaaaacatctagaggaaatgcaaaatttcctttcacctgatagctatattcaggaaaacacaggctactggatattttacataagctctgaagtgagacggtccctgggtacggcttgaattgtctgggtcggttcctcaagtggtctctgcagtttcctcatctataaagaggatatgaacatggtctaccttacaaggctgcaaggaattaaaagaggtatttcagggaaacagggtttctatagtgccaggtttgcggcaagcactcaccgacaccgcctgcaggtatggcccgttcgcgatgttctgggcagtgcagcagttctaggatttgaaaaccttccgggttgtgttgcctccaccctttcctcctgcagttccttcacaagcagccagcatgaggcttcctgaagtcagatcatgtcactccattgttcaaaagtcaaattttctcaacagggtcaaatcctgggcccagcagaccctacctgacctctccaccctgccctttttctgacatcctcttctccgagctccacctgctccaagctccaccccatactggctgctgcgttttctgggcgggggcctgcctggggctcacgagttgctgtcgcctctgccatttggcacacaaatggatgctccctgagggtgccctcctcacagtttagctcatcacacaggcctcgcggctgctgtatattacggaactccccaccaatactctttgtccccttgactctgctgtttctcgatagaacacacacttactagctgctccaaatagaatagctccgttgaggtaggcatcttgtctgtttctattttctgctacatcccagtacctggcactgtgcttggcacagagtaaggactcaatcgttatttgtttatgtagttcgttaactgtatgacggatattggaggagcctcctatttttttgctaggtccaatagcttcatctcatctgtcaggagatgatgaatggcgcctcatttaggaaacaccaataacacatgaaggtaatttacacacaggcaccctggagcccaggtgcagctcaacgttcttattgaaaatgtagtaaaaatagattttattcactgaccatattttaaggaatactattttttactatttcgggcagtactactcaaagcacagcccctgggcccgcggtgttagcatcacctgggagcttgctggaaacgcaacttctcagcttccatccaaggccaactggtctgggcccagtcatctgtgcttttataggtcctcaggtgattctgatgagcactaaagcttgagtggcactgctgtaaaaactacttcaatgactcgttccagttctttgacgtcctcttacaagtctttagtgtgacatgcttgcgttcttagtaccaacagtgtaactggttcttcatgtacatcatgttatcacctctcatgttgaccacttatcttttgccaactaaaaatacttgaaaggcaccttctcgggtttcagaagtttccatttgtttcgacaacatatgaggctacagcccagctattcacccattagagccctcccacgtccagccagcacttatattcttcgaagttaaaattgaagactctggaagcacagaaaattgggatttcttttaatctctttttctgaggcacaggttttcaaacattgtataaccaaggatttttttcatcttttcaaatgatagatgttttatgtgtttaatatgtgaagtacgtaaagaggaatggtctcaggctgctgtgattggcttggtgtgttcacctctcaccgacctgcctctgttctcccacccagcgtccgattgttccgtgagaacaacaggtaggatccataattgtaaggctggaaaaccttagccatagggcagagtttctcagagtatggtcagtaccaacattttggggcctctacccccagacaaatacatcaaaatttctggtcacagaaaaagaatgaaagaagattttttttctcgccattctggccatcaaagaaacatggaaaaacatgcaagataattctgcacatgagagtctgtgaatctctgctctagtaactttacgctatcatttttagtgaagaaaaataatcatataggcatactgtttgcatatagtcatttcaaatcattccattcagtcttaactcaaaccaagaatgaaccaagacatttgaagagatgaaatctcaatttctctgtataattttaaataaagcattcgctctaaaagctaaatgcacaggagttctgttgaatgactgactatgtttacaatttgaagcaatttagtaaacatgtatcaccactcttctaagagattttggggaaaactacagttaattggacaaaaactccatcctcaaagagattaaaaggtgaagtcagaactggagtacaaaatagcaagtaataagggagagtcctaagagttctgaaaaggattccctccagttctaatgagcaggagaggattacttgtagtttagctgttagtttaacacagagttaaatctgaaagttgacctgggatgcaccatctctcttttcccaatctttacagatgcaacatatctttacagaggccttttagtagcagcatgtagggtgccaggaagttgcccccagtgtgtagtggtgcagggagaagtgttaggatggcaaccctgcagcccccaactgcaccatgtagagttgcctgagccagtccctagcctgccaaaagcacaaggctggcaggccacaagacagaggggtaaatgagaaacagggtgatcagaggttagatgtgactcagacatgagtggaaagtcaaggtgaaacagcgcatcatcatagatcatacagtactctgaaggctgctgtcatttaccacattccataaatttactagaatttattctctattgtttgggttgaaataatcacacatttcaatttaaaaatataaagagaatattagacatttagcagaattttctcagtgcctactggtacttcagaccctatatagagagaatactatattttcttaaaatattatggtctagagagagagagagagtcagttgaaagtgtcaataattctaagttcattctcataaaagaaaattctggagaagaccaagggcaattttatgataaaacaaaataagaagactaaaattttcagatgaatatggttgataagagagtagagccagatgcactaggaaatgtattaaagaacatgaatatgtacacaacaggattcttgtgctcaaattgtttttaatattcagataataagtaaaggtttaattttgctctaaacaatgtgatttttttatttttagtaagaattttattttgggaaatcaaattaaagaactagtagataggtctcctaacataataaatccaatctgttatacagttgtacaggaacaaacatagtaaatatagggtttggtaccatttttggtttcaggcgtacactgggggatttgaaacgtattgcctgttgatggggagggacaactgtacatgtgagacacccagaaaaaatgcataaatctcaaagaggtgcctaaaattcaggcttgaataccatcttcaatggcaaaggaagaaagggagaggagaagacaagagtaaggtttgttaggcagattattcagttggtgccttctcaaggatcagagtctccagagactctgtcctcctcatcctagtaaggagagggagacacccttacaaatggagacttccttggtagatataaatttcccttacaaaagggtcacttctactctgtttttagagcttttcctgtgtctactgtttctcaaaataatcagcttaaaataatacttatgctaaagtggcatattttggggtggcatattctggtctcatacacactcaaggtggaattttccattgtttggtttataatgttggagcatgagtattctctagaggtgtcagtgtcagaatgatcttatacatactctggttgaaacgtcagaattgttatgggcttgggttcgatatttatattaatatattattctggtcacaagagtattgcaggggtttagatttatctcatttttccccatttttgacatttatttccatttctcaatttttctttccagacctgaggtgcccagctcacatgaagcagagcctctttccctcccacaatcatctcaagatcaccagagcatcagttaatgccttactttctgggcttatctactcctgtatttaaagatgttgtttctacattttcacttgtccttggaaattatctttttttattttttgcaagatcatcgaaaatttttaagttccttaaattttatttagtaagtttagtaggaggcatttcttattatgttaggcttccatcttgcaggccccagaactttctgacactgtgaaggccataccagcccacaactgccaggatctattgtatgtgggaggaaaatcaacttctaccctgtaaagtcattgtgattattttgtgtcttctgtcaaacacagtaaaaattaattctattacacctttgactatttagattagagaataaaagactaagaggcacatattaatttttttaaaataactaaacaataacaatctttgccaaagaaaagcattttgaaatgggtggtagcatagagagaaggaagagtcctttcacactaaggatgtcattgccattggcatatctggctttagaaactacaaatggctcgattagctttagagttctttctgctttttagaatttttctacatcactagaaacatatctcttatatttaatctcaatatgaaaacctgtttcatagtacttacaataaatgcattctcaaatgttacatcaaagtactccacctacagtgatgtctccttgtagtgaattagagactccaatccaaaacgtatcataaactaaatatgcacccggtgaggccatgctccatgcagactgcactaaacaaacaaacaaaatgctttaataatcttagagcattccaattacctggacttccagctggtggtgagtccttcctgctgtcagtgtgcagaatgacagccagccccacagagtctcctgggaggactgagctgctgaggtccacccgagtcaagctctggggctcccgctcacagcctcccgccgcgtttctggggtcgtcgcctccagttgcattcatttcttgaccttttctccacggtctctgcacaatgtgaacaatgctctgctgatccaggtcacaattctgtttgggagcaaggtaaaaaaaaaaaaaaaaaaaaaggaaatgtcaaacatgaaatgcgagatagagtttaacttgccctccgtggtagaagggaagcaaaagtgacatgtaactgaccaacttaggtgctcctttgcccacagcagttacacactacacacggtagacaaacaacactgaactggggccagaaacagaaatttgggaatacgtgaaacacaatagaatgctgacgtcatattcaaaaggacataaaatctagcaggaaaaaataattaccaaactggatctataagcacagtgaaaacaataattccttttttccccccaagacagagtctcactctgtcatccaggctggagtgcagtggtgtgatttccgctcattgcaacctctgcctgccgggttcaagcaattctcctgcctcagcctcccgagtagctgggattataggcgggcaccaccacacctggctacgaaaaatattcttaaatagtaaaactgattgacatcagaattgatatgtcattcatctctgttttacaaaagtacagaaagtgagttattatcaatgagagggcatttctttaaagcatcggaaatgaatgcgtttgagtaggctccacacacaccgctccacgggcaccaacacacacatcattacactggtggggaagcaagacaggagcacactcttgccacccagggttcattctctttctgacgatttaaccatgaaaaccagctaacatttacgaaaaggttttgcatctacatattgacacgtaggaacagaagactttaacattttgtagcataaaaattaaaagtcagattatttgctagcacaagaactaggctaccctaaatggaattctagtttcagaatatctactacatagggccggccgcggtggctcaggcctctaatcccagcactttgagaggcctaggtgggtggatagcctgaggtcaggagttcgagaagagcctgaccaacatggcaaaaccccatctcaactgaaaatacaaaaattagctgggcgtgttagcgtgcgcctgtaatcccagctactcgggaggctgaggcaggaggatcacttgaacgccacccccacccccccaaccaaaaaataatatctactacatagaagcagttactcatatgcttgctaccctcttaagacacagcaaggaccttactctctcagtaaatcgatgtggccggccgcagtggctcacacctgtaatcccagcactttgggaggccaaggcgggcggatcacttgaggccagtagtttgtgaccagccagggcaaaatggtgaaaccccatctctactaaaaatacaaaaaaaattagccggctttggtggcatgtacctgtaatcccagctacttgggaggctgaaacaagataattgcttgaacctgggaggcgaaggttggagtgagccaagatcatgccactgcactccagcctgggcaacagagagagagactctgtctcaaaaaataaaattaaattaaattaaatacaaataaaccaatgcctttcaaatacctcttgccattgtcattttaggaatgctccaagaacactcaagtgaaatgcatccataactcatagcgatgaatgatgcccttccctgctgctttctcaagctcttctgttgccctcaccatcaatgtccctcgaacagtggtgcccagcactcaccaacacccctgaccccaaatacaatggctagaatctgcctcctccacccaggagggcaccaggacacccttcgtccttaaatcccattccaacctcttctctactcttacaccctggggctccgtctcatccccaggccctgtgcccctccccattctcagagctcccagtctctccctaggactgctcctactcagcagaggccactgtgcatcattctctgacctgaagtgctcccctgcatgacttcccagtttctgtcaaaggaaaaaccatcccccacatcacccgcttcgagccttcccctcccacctaaaaatctcattatcctcccatgttttgtaacgggctgcaagagaatcactatcttgaattcctcctacctaatctttgacatcggcaaggcaccaacagttagcaattctgtctcagaattacccttcacatcttcaactcttttacatctcaatagtcacctccccgttttaggccttcctcatgataatagctttgtaattactccccacatctgatatcgccatactccagtccaatacatacaagaattctgggtgtgtgctacataatctttctaaagtgtctcagtattacttgtaaaatggactgtaacatctcccatgttcttcaagtgtgtttgtacttttttcctttctaaatcatgatctagatttgatttttcatcttccttacccctcctatatgatacatgtggcagattaaactattcttcaaaatcatgcacgcctgtacattagtgcgcatacatcatgctccccacttcctccctgcaatctgtgtccagccacatgaatggctttggccaaagggatgttagcagatgtggttgaaccagggccttatatttgtcccgctgctaaggtccatcaaaagaacatccctgccaggcacagtagctcacccctataatccaagcactttgggagactggggtgggcggatcacttgaggtcaggagttcaaggccagcctggccaacacggtgaaaccccgtctgtactaaaaagataaaaattagccgggcatggtggtgcgtgcctgtaatcccagctactcaagaggctgaggcaggagaatcacttaaacccaggaggcgaaggttgcagtgacctgagatctcaccactgcactgcactgcacagagcaagactccgttgcaaaaaacagaacttcccagaaagcttctacctgttcacacatggcccagacctgagtccaacccactgaggtgaccaagtgcagccacactcacagcatgaagcagggacccgcagctgaagccagcctgaggccgcgggcaccctcgctgacctgtaggcacatgagaagatggcatacttttatggcactgagatttctgcttgtcctctaatcaataatggcagacagtcctctattttccattctatttggacaagctatcactgtccatgatcagctccgtgtcaggcagcactcctccagctgtgcacagcctctagcctaagtcgtttcagagaaatgggcatcaggatccgagtatactcaaggacttgcacaggagcatgtgagctttgccacagaaggaaaagtggagaattagcaccctagcctatcttgaggtttctatccacattttttccctacctttccatgttcaggactcagttacttcctgtgatcctcctagagaaaagtaacacctttctccctcatctgaatctaaaaatctttgcttactgtgctcttcttattgcagtggttagagcttggacagtatatacatatatattgtgtgtgtgtgtgtgtgtgtgtgtgtgtgtgtgtgtctgtgtctgagtcttatcttccaacttattttagaaatacttgagagcagcaacttggccatagtagcattcatcagaacacctcacacagtgctttggagccaggagatgtagaaacatatctatgaattctaaaagtttgaaaaagtgaatgactgaagggaagtaagaaagaatgaaggagtgaatgaatcaatgaatataaacagtcataagctcagtgcccaaagtgccacagagggaaccagcagaacaagaaagaaaggacacagaatttaaagtcaaacggactcaagctctacataatttattagctgtatgaattttggcaaatgattcttcctttcccagctttctgccattgacaataatatatcaactttgaaggctgttttgaagatttaaggaaatgtaaagagctcagatcccgatccgcaatgatacatcgttggtagtattgttaccatttatgagtttcagaaaactaaagaggatgggtccctaatcttgtacatgaataaggtgtcagaattctgtttagctgcacacttctgtttggaaaatatacagagaaggcagaataagcagaagctatcaatgtgacaatctctctggtagcattccaactttctgtgaactaaaaatcgatacaaaaaaataattcctatatcaccatatagccagatgccatgaaacacgtgaagaacctgagtgaattttcagggacaggtaaaatgtgacaaatgttgatgaaatctaaaagatttcaaatccagattttcctaatgctcagggtacagctgcaaaggggaaaagaaagttctcaaacagatttcagtagttacagtgatacttataggacgcatttccctcagttggcatccctgtttctgaaatcattaattgcttaatctttgactcttacagaaaatcttcttggttccagaagcggtgcctttgacagacagtggactcacacaccacactggttcagttcaaagccacattccatggacagtacattggatacagtccagttgtacagccacgcaaaagccccaaatactacttagttctcctagtatacaaaaaaattcctcagatgtgggaagaaagagattttcggtgggaagacatcagagtgctccaatatggtttcaggctaccttagagcagaaacaatgtcttatttatctttgtttctccaataaataaaatattacctgtcaaagagaaaacccttaatacaattctttctttttttataacaatatattaatccaacaagtaaggcagtaacaaattcttcagtgtagacaaaccaagtaggtatttctgtaaccgggtttggtcttacactgtcaagcacagctgatgacccatgggagactgagggatcagtatcttgggctttctgtctataggatccttgacatggaaacataccagtattaacaaaacatccatgggagttttttttgccaaacaatgatcaactctcatctggttggacattatccaataatatacaaaaaactgatgtatttttctttttccaaaaagaagttccttcaacggcacatagttaagatccaaatatttcagattcttccaagcacttaataaagagttacaaatatcatctctaaaatgattaataatgagattctaaaattgttaacaataccacattattaatacattgttttcaggagttatgaaaatagttatgttaataataaaaaacatatagaatatacttagccgtatattgcagaccattacaggttttgagacataataaattatttattattctcacactctgatgagggaataactatcaccatctgctatgtctcaatgtgtcctcaaaatttatttgtttcaacttaaccatcaatgtgattgcatgaagaggtggagcctctagaaggtgattaaatcatgatggggcagagccttcatgaatgggattagtgcccttataaggcagtgcaagtgactttctgtcctttttgcccttttagctcttcccctcttccagcaagtgaagacacaacaagaaggccctcaccagacactgaataccaacaccttgaccttggatttcccagctttcagaattttataaattgcccagtctcaggtattttgttatagcaagacaaagaatacaagacaacatacataaagttagtgtgtaaacagagctagaaatagtgtgtaaatccaagagaactgtgcctggcacagataatgctgttttacagattacttattgtggttgctgttgattccactttatagaagacaaaggggagccacagagaagttcacgatgggttcaacaacacccagctcccgagtgtgaagccagggtaggaacccaggccatcgactcctctgctggtgttcattgactctgctgagaggaagtggagacttggatgaggcagacaaactaggacaagtctacaggggcccatggtgaagaccagggtttggatgctgcaacggaaccaccccaggtacgaaggaatgattcagagaagagccagatagctgaaatgttaaaaacatgagaagacaggatctgggacggggctgtataggaggtagcaaagtaaagattagtccagtgtgattttaaagaggaaacaaaacaaaacaaacaaaaaggatgaaagtaagaacaagtgggttgcagaggaatcagtgagagtatggaaagtgaaaagaagatggtataggtgagctggtaacacacctcgcagactccggatgctggtgctggctcaaggtaaagtctgtacctctggagatcccgtcaccccagggaagactgcacttatcacgtcgtattgtagtttctttgtatgcgttgctctctgttaccagacaataccgtctttaagaaaaaatactgcaactgtgtctgtagtacctactgtagggacctgttcataaaacacactcccctgtgtctactgaatgactctatgatcctttaagcacatacctagaagtgaggaaacattccagatggcgttagtaacttacccaagtcaagtctgatgcataattgggaaatgaaagagccaggcctgcagcctcagttttctggctctgagcccaatgctctatttcaaacatcccaccttggattgtccacctctctgtgctcacgacataagtagacatgttggcagaagtgcccagccagtgtgcttttatcagcatactgatcagtctatactcattggcatacttactgtaccactgtctatggtctgtaaagtaggtagggctgtcttcaatatcttcagtatcattcattcattttcagttccttctaaatctgttaaactctatttcctcatacaaaatgcttaaaatcatttcagtgtatggccaacaaacatatgaaataatgtttaatatcactagtgatcagggaaaggcaagtcgaaaccacaatgcgataccatcttactcctgcaagagtggccataataaaaaaatcgaaaacagtagatgttggtgtggatgcggtgatcagggaacacttctacactgctggtgggaatgtaaaccagtacagccactacagaaaatagtgtggagattccttagagaatctaaaagcagaactaccatttgatccagaaatcccactactgggtatctacccagaggaaaagaagtcattatacagaaaagatacttgcacacgcaagtttatagcagcacaattcacaattgcaaaatcgtggaaccaacccacatgtccaccaatcaatgagtggataaagaaatcgtggtatatgatggaatactgctcagccataaaaaggaatgaattaatggcattcacagcaatctggatgggattggagactattattctaagtgaagtaactcagggatggaaaaccaaacattgtatgttcttactgatagatgagagctaagctatgaggacacaaagacataagcatgatacaatggacttcagggacgtaggggaaagggtgggaggggagtgagggataaaatacaacatatatggtgcagtaggtactgcttgagtgttgggtgcaccaggatctcacaaatcaccactaactaacttacgtaaacaaataccatctgtaccccaataacttatgggaaaaaaatcatttcagtggaaggctgtcaaactttctaatgtgtaataactttacattttaaagactgaacatttctgatttttatttggatttttaatagactacattttctatctagaaaaggaatacaatcagccaagaatgatcagactaatttaaaaatcaatagtgttaacagattctaatgttaaaacatttttacattgagttctttcttaaataactttgaagacacacttttaataacaccttaaattgtccttttttgtgctgaacaatcttggcattctttctattttttgcttcttctgaaaataacttctaacaaacagatttttttttttttaaggcagggtctcactctgttacagcccaggctggagtgcagtggcatgatcaaggctcgctgctgcctcgaactcccagactcaagtgatcctcttatggcagcctcctgagttgctgagactacaggcacacgccactacacctagctaattttctagtttttttttttttttttttttgtagagatgggatctcacttatgctgcccaggctggtctcaaattctcaaattcctgggcataaatgattctcctgccttggactcccaaacactgggattccaggcctgagccactgcacctggctttaagcagatgtggttggaagcccatcacagtttttaataacgtattttctatgccaagaaaagacaaaacggcaatgatttaataagttaggccgaatgcagtggctcacgtctgtaatcccagcactttgggaggtcaaggagggcagatcacttgaggtcaggagtttgagaccagcctggccaatgtagtgaaacccgtgtctactaaaaatacattaaaaaaaattagccagacgtggtggcacaagcctgtaatcctggctacttgagaggctgaggcaggagaatctctcgaacctgggatgtggacgttgcagtgaaccaagatcgcaccagtccactccagcctgggtgacagagcgagactccgtctcaaaaaaaaaaaaaaaggtgttatttaaaggtgttttttaatgtaatggctaagaactattttgtttggtcactgctaacaatgaaatgtgtttcaagacaagatgagccagagatgttcacagtaagtcagaataatcaaaaagggaattgttcccagtgatattttttcacttgaactccagttcccctccatagttttcaatgaacactaaatgccaatttatattaattggatgagaacagaaactatcctttcaaactgatccttcatttaaaaaaagggggacttctaaaagatgaatatttgtgatttagcctttcaatttatttcacatttcttatgactgattttcattatgatcaaaaatattatgctgtgtaaagatactgaaaggccccttctctggttcccaaaggcaggcaatacaattactgtgaaaggtcaattagccccacactaattagccagtgcaggcctgggccttgtcacctccatgtccctcccaccacaggcctgagacctttctgctgctcatgaggatcctacaccagaggggctccatagggggcgggaggggggaccgctcaggaatcactcggtttggctacatgccagcaactgcagtaagtgatttagttttgaagagcagaggacagtgctgtttgagcatgtagggtcgggatttcacttctctgggttccctctttcatgaatacaaaggatatcggatcaccaaagctatgcccattaaacccactttaaaattgtgttttatattgtcaacattgcaagaaatgcctcaagtatcacttcttttttctttaagtattattttattactagttgtgataaatattatgaacactttaaaatatatatattttatttgacagaattaaattaatgtttttaaagccatggaatacgctgtatagaattactggggtcagggtttgagagcttaacaacacacgctcttgatgaagctgacccggaaactcaggcacgtcggggaggtcagcactacccaacagaaccacatgcgagtttatgccacgcttcccaaattccaatggttgcgattaacactcaaaatcatatacctccgcgattgcaaaacaacatctgcgcaaggtgtttactgtgggattatttataatagaaaattatgggctgggtgcggtggctcatgcttgtaatcccagcactttgggaggctgaggtgggcagatcacccgaggtcaggggttcaagaccagcctggcacacgtggcaaaacctggtctctactaaaaatacaaaaattagccgggtgtggttgtgcgtgcctgtaatcccagctacaggctgggaggctgaggcaggatactcgtttgagccgggaggcggaggttgcagtgagcctagatcgggccactgcactccagcctgggtgacagagtaagcctgtgtctgaaaaaaaaaaaaaaaaaaaaggaaaaaaaattttcagaaacaagtgaaatgcttgaccatagaagacaagtacaatctgtgaagaaaaaagaaaacaaagcagaaaatagaatatagtaagggactttctatgtcaaaagcaaagaaaattaagtacatacaaaagtagctgtttttgtaaaaggaaacgtagaaaggaaaatcgaagttagtgaaaatggttacctatgagggagtagggaaatgggttaaagggatcgaatgggagccatgtttccctaacgtgactatctacagtttcaggtgtgaggcacagaaaatgtttcacaaaatcacaacaatacttactaaataaaaaggagaaaaaaagcaaactctaaaactgaaaattaccagaaacatattgagctgacaatgtcagtacataaataaaagtagttcaagtaacttttggacacagtgctctgtatatcctttagtacaaaaaaaggaacccaaaagaaattttgtactttatttactaagttgattactggtatgatataggtgtaggaattcagaaactatttgtatttatgttaagatgaaaaattactaaacttactgatgtttttggaaaccgagtttttcacagtggctgaagaaggtgagaaggagcttcatgatgttggagttgaaataaaggaaacaaaatgtacttatgaatttttaaaaaatccaattcattgaggggaaattactcacctatccagaagttgcagaataatgagacccatgtatatctattcatcaccttattcaacaattatcaacttgagtccaaccttgttttatcagtatgaattatcatggataaatgatattatcaatatcactacccactttcccttcctatattattttgaggcaaatctcagatatcatattatttactcaacaaaaatgatccatatgtatctctacgaaggaggaattttcctataaaacctaactagaataccattagaggaactgaaaaattacaaataagcatttaatggcatcaaatatttatgtgtccataattttaattttttccaaatctgtttgaatcgagatccaaacaagtccatattttgggactggaaggaatgtatattatatcttcttgtaatttaattaattaatttattaatttattaatgtatttatttatttatttattttgtgagaccaggtctccctctgtcactcaggctggagtgcaggcatgatcagggctcattgcagtctcggcttccagggctcaggggattcctaacctcagcctccccagtagctgggacaactggaatgtgccactacatccagctaattttttgtatatgccatacagacagggttttgccatgttgaccaggctggtctcaaacttctaggctcaagtgatctgcctgcctcagccttccaaagtgttgggattacaggcctgagctactgtgcctggcgttcaatgtttttttattaagacataactaatatattgtagttctcccttttaaagtgtataattcagcagtgtttagaatatttgcaaggttgtgcagccatcaacactctctaatttcacaacattttctcttcagttgcttttacaagttccctcacccatctctcttcctgtttttacaattaaatttgaagaaaaatgggttaatccattgtagaatttctcataatctaaattttgccagttgcatatgggtggtattactgaacaagtttcttcattgtccttattatagaaaattttatatttgtggccaggcacagtggctcacgcctgtaatcccagcgctttgggaggccgaggcaggcggatcacaaggtcaggagatcgagaccatcctggctaacatggtgaaaccccgtctctactaaaaatacaaaaaattagccgggtgtggtggcaggtgcctgtagtcccagctactcgggaggctgaggcaagagaatggtgtgaacctgggaggtggagcttgcagtgagtggagattgcaccactgcactccagtctgggcgacagagcaagactctgtctcaaaaaaaaaaaaaaaaaaaaaagttatatttgattctacaggcttgactaggtttaggcttaatatgttttgctgggattcctgtaagggtgctgctttgttcttcaagaaggaagcactatgtgactatgcctgagtctgactacatttggctgtagtgtatcttctttatggaagatacgctaaaattgtaaaatggtgatcttttaatattatcacttcttctcaaactattagataacatatttctatcaagataaattttccctcaatagctattttgttactcagagataaattttgtataggaaggcagaataaatgctctattattttcttggtttatacattttcaaaataagttgactctagcaatgaataaaaatgcaatttttaaaagcattattaaaaaattatagaaaaggccgggtgcgaggctcatgcctgtaatcccagcactttgagaggccaaagcaggtggatcacttgagataaggagtttgagacccacctggccaacatggtgaaaccctgtctctactaaaaatacaaaaattagccaggcgtggtggcggatgcctgcaatcccagctacttgggaggctgaggcaggagaattgcttgaacctgggaagcagaggttgcagtgaaccaagaccacacaatcgcactcctgcctgggtaacaagagtgaaaatccgtctcaaaaaaaaaaaacgaaattacagacacacacatattaatgatgtccatcgattgtacttattattttgattggtggttatctatagctaattggcacatcttagaatgggatcctgaactgtggcagaggcgcaagagtctttggtagcttccctgccatcctgtatgacaagagactccagtctgctttgaacactttttgttctagacctgtaataaatcattttgacaaataaaaatggcatttaaagatgacgatgtggatggttagagatactcattgctagtggattcataaacgtctgtcagctttttcagtgacaagaggtatgttttgttcgttttttaaagataaaatacatcacgagttcaatctgatatttcccattcaaaccgaggagtagagggttttaaataatctccttcgtcttccatcttaatcttcttttctcttgttcaaaatcgtgaaaatgaaatgattagatgtcacataattactcattattttagactacattatatacacaatgtgaatgataccattaaattgattactaatcatagtttaagtttttctgcttgtagttctttttgtcttgggatgtacctcattaaagatgtatagtcaaactgctgtattctaaagtcacttggaataatgtggctatgattacaactaaagatacttgcattcatttttttgactttattttttattcttagaactttctatttaaaatatttaattctgttttataattatggaaaatattttcaagtttctaaagtcaaactttaaaaacataaaattgtcaaagatgtctcacttctacttttgtctgtttaatatattcactatctttttgtttgtttttagatttctgctttacctctaacagaagctggtgtgtgtgtgtgtgtctgtgtgtgtgtgtgtgtgtgtatttaagcacctctcttagataattgatagcatgttatatacttttttcgcttaatttcccctacaattaattctacagtagtatatacacatttccttattatttttcacaaccatacagtaacctcacgtgtggataaatcatagtttattcaaccaataccctatgttctatgacaaatgaggtcccactggccaagtttgggaaaatataaatacaaaaaagaatagattgataacaggttataatacattaaagaaaaaatccatgaatatatgataatattaaaaagtatacgtgtgaggagtaagaaagagttcttccatacagaacaacagaataaatatggcaagaactgtcggcacagacaatcatatttttgaaggcactgatataataattaattcactcaaggatcaccagtagaagctacagcaaatggatccaagattggtgggaatcgggattttggcagtttccaagtatctgcccacagattccctaataatttcaaaagaggagggttatttctgcaatgggagattcggcaggcatcactgtaactaagattcacacgggcattgtcagttacaaaggattcagcattaacgacaacaaagtttaacccaaatttagcaatgaggagacaataaaacaaatcgaggttgcaggataattctgcaaacaactgacccttacaattcaaatttttgaaggtgcaaattaggtgtgtgtgagaagactgttctatactaaagcaaaataaagatacatgataactgaatgtgatctgtatatttgactaaacttttggtcagaataatttaaaaaaattatccaaagcatacaaacaacctttaaaactcatcagtaaataaataaacaaacattaaaaaagggccaaaggctttaacagatacctcaccaaagaagatacagagatggcaaagaagtaggctccacatcttatgtcctcagggagcagcaaattaacgcaagataccactacacaccaattagaataaatcccagaacaaaggcaacaccaaatactggtgaggacgtggaataacagaactctcgttcattgctactgggaatgcaaaacggtatagtcactttggaaatctggtggtttcttacaaaactaaacatactataaccacacaatgcagcaatacctggagtatttacccaaaggagttgaaaactaaaatcatgtccacacaaaagcctgcacacagatgtttacagcagctttattcaggattgccaaaattcaatgcaaccaacatgttcttcatcaggtgaatggataaagtatcagacatacagatcatggaaaattattgagcactaaagagaaatgaagtatcaagccaggaaatgacatggaggaaccttaagtgcatattaccaagtgaaagaaccaatttgaaaaggctacatcttgtatgattccaatttgaaaaggccacatgttgtattatacgacattcggaaaaaggcaacactatagagacattgaaaatatcagtagttgccagggactgagggatgacggagggatgaatagagacagcacagagaatatttaaggcagtgaaaatactcagggtgatactatgttgatggataaatatcattatacatttgtccagacccacagagtgtacaccaagagtgtaccctcatgtaagctataaatgtgaagtgattacaatgtgtcaatttaggtttatcagctgcaaaaaatgtaccgctctggtgggggatgttgataatggagagggtatgggcacatttgggcagggagtagatgggaaataccttcctctctatgatgtgaacctaaaactgctaaaaaataaataaataaaggcttaaaaaagctataaaggacaatttgggaacaattgggaggatctttgaatatggactacaaaagaaatatcattgtatcgatgttaaattccttgaaatttacatcacacattacagcggctacacagaagattgccctttgcctttgtagatataggctgaagtgtttaggaacaaaatgtcagtctatctgcaattatgtttagcttcttgagagacagaggaaaggaaggaggggaaggtgtgagtgagggagacaaagaaagataaagcaaatgtggcaaagtgttaacagttggggactctggagaaaggttgtacagatatttgctataaatagatttttttaaaaaattttttaaaggtttgaatctcctaaaatatcttcatactcagtcactaaatggaaagtaaccactgaaaatcagaaatgttggcgaggtgaggtggctcacggctgtaatctcaggactttgggaggctgaggtgggtggatcacttgagctcaggagttcaagatcagcctggccaacatggtgaaaccctgactctgactctactaaaaatacaaaaaattagccaggggtggtggcaggagcctgtaatcccagctacttgggaggctgaggcaagagaatcgcttgaacctgggaggctgaggttgcagtgagctgacattgcaccattgcactccatccagcctggacgacagagactccattaaaacaaaaaaaagaaagaaagaaagagagagagagagaaggagagagagggaaagaaagaaagacagaaaaagaaagaaagaaggaaagaaagaaaaagaaagaaagaaagagacagaaacaaagagagaagagaagagaaaagaaaagaaaagaaaagaatcctctgtcttaatcctgagttctaatttgattgccttgtggtctgagagactgtttgttatgatttctgttcttttgcatttgctgaggagtgttttacttccaattatgtggtcaattttagaacaagtgctatgtggtgctgagaagaatgatttggggtgcagagttctatagatgtctattaggaccgcttggtctagagctgagttcaagtcctgaataaccttgttaattttctgcctcattggtctgtttaatactgacagtggggtggtaaagtctcccactattattgtgtgggagtctaagtctctttgtaggcctctaagaagttgttttatgaatatgggtgctgctgtattgggtgcatatatatttaggatagttagctcttcttgttgtattgatccctttaccattatgtaatgcctttctttgtctgttttgatctttgttggtttaatgtctgttttatcagactaagatcgcaaactctcctttttttttgcattccatttgcttggtaaatattcctccatccgtttattctgagcctgtgtgtctctgcacatgggaagggtctcctgaatacagcacactgatgggtactgactttttatccaatttgccagtctgtgtcttttgattggggcatttaagccatttacaattaaggttaatactactacgtgtgaatttgttcctgcattcatgatcctagctggttattttgcacattagttgcagtttctggaaactgaacaacctgctcctgaatgactactgggtaagttatgaaattaaggcagaaataacaaagttctttgaaaccaatgagaacagagacaatgtaccagaatcactgggacacagctaaggtagtgtcaagggggaaatttatagtactaaatgcccacatcagaaggagggaaagatctagaattgacaccctaacatcaccattaaaagaactaaagaagcaagagaaaagaaattcaaaagctaaaaggccaggcatggtggctcactcctctaatcccagcactttggaaggttgaggtgggtggatcacttgaagccaggagttcaagaccagcctggccaacatggtgaaaccccgtctctactaaaaatacaaaaattagctgggcatggtagcgtgtgcctgtaattccagctactcgggaggctgagggaggagaactgcttgaactgagacctggaaggtagaggttacagtgagtggagatgacgccactgtattccagcctgggctacagagtgagactccatctcaaaaaaaaaaaaaaaaaaaaaaggctagaagacgacaagaactaactaagatcagagcagaactgaaggagacagagacatgaaaaacccttccaaaaaatcaatgaatgcaggagctgttcacatatacaccatggaatactatgcaaccataaaaaagaatgagatcatgtcctttgcagggatatggatgaaactagaaaccatcatcctcagcaaaccaacacaggaacagaaaaaaacactgcatccatgccataaaatacaactcagcatagtattccatggtgtacaaaaaggatgagttcatgtcttttgcagggacatggatgcagctggaaaccatcattctgacaaactgtcacaaggacagaaaaccaaaccccgcatgttctcactcataggtgggaattgaacaatgagaacacatggacacagggaggggaacatcacagactggggcctgtcagggggtggggggctagggaagggatagcattaggagaaatacctaatgtaaatgatgagctgacgggtgcagcaaaccaccatggcacatgtttacctatgtaacaaacctacacgttcagcacatgtagcccagaacataaagtaaaattaaaaaaaaaataagaaaataagaaatgcggtattactacaaaatttttaggatgaaaaattgtatgtatttcatgctatctgtcatgaattcagctatctaacctgctatatcctacacatagcttacaaactgacctaagaaaggagggaaaaatgaaagcaaaatccaaagttgcttataaaaaagaaatctttgttttggaatatgagaaagctattgtataaatacagattaccaatatggtttaaatagaagaattatagtcaaataccatagcaaatgagttaaaattttgcagctcattacagttttgaggtctctaaagtgaataagcataatacccaaaatactgactttgtagaatcctaaaatccagttatgcagtctacagcagcagtcctgaatctttttggcaccagggagtggttttgtggaagacaatatttccacagatgagggcaatggggatggggtgtggtttgtggatgaaactggtccacctcagatcatcaggcattagttagattctcgtaagaagcacacagcctagatacctcacacgtgcagttcacaatagggtttgcactcctatgagaatctactgccactgctgatcagacaggagctccagcgtcatgctcatctgcccatactcaccccctgctgtgcagcccaggtcctcacaggccacagacaggttctggcgccacgggggttggagacccctggtatagagcaacgcatgggcaaaagcactgcatgagtaatcaaggtcaaaggcagaattaatggatgttctaatttactatggaggcaacatagcaaaacctcttaaacattttacaacaaagatcctgtccatattacagtcttcaaacagatatggacttccatacaagaagagtatattaaaaaaaaaatccacaccctctcagatgttcactcaaagtgataaaaatggaaacaatggaatcacatctgctaaaatccatattagaaagtatacaaataaaagtgcttatgataaacagctaatgagaataaatggatacactattaagctatcttggcagaatttatcaatgtcttagatgtacatgcagaaattctcacatatgtcctcaaaaacacatgtacatggatgtcctttgcaaccacagtaaaaaccatggcaacaatctaaacagtcatcaatattgggctggctgccattcatacatacaattggtaaacatttgttataactctagaagtacacggaaaagaaggcggtctattttttaaataaaatcagcaagttgcagaatagcatgcactattattattagcccatttgtctgtatgttgtatatcactctgtatatgcattaacttattgggtacacatagcaaattttgattaactctgaagaatgggattaagtgatggaagagaggaatttgaatgtttctgaaattttaaaaagtctaagcacacattactttgataattttaaaaagacacctgggaaattatttgcaagtaaaatactcatttaattcctgataagctttcctttctttctttctctctctcttttttttttttgacagaaaagataatgacagtaaatgctttacttagaatagaatggaattttttttctacttttctgtcaatgtctttatggatgatgttgccatcttcattttgtcactgttagttgtaacttctttctgacctatgttttaccctttctggctacaagctcattttacacacagttatttatatgaacagttgggagccactcactcacctctcttttgagaaaagaaaaatatatttgtgctttctaacttttattatctttatgccaataagtctttttattttcacctaagatttgtgtccatttttggaatggcagagatgctggaaatcatatttcaatccaactgaaatgtacgtgtgagtgtgtgtgtttgtatgtatgcatggttttatgtctttagaattctttgtgagtgctccagtaaatctggtgccttctgagacgacaagagaggattaaggaaatggtatgagttttttgtaactatctcaatgaaaaagtagagaagcatagagtgaaaaaatccttagaacagtcttgctctgtcgcccaggctggagtgcagtagcacgatctcggctcactgcaacctccgcctcccagattaaagcagttctcatgcctcaacgtctgagtagctgggattgcaggtatgcgctatcacacccagctaatttttgtatttttagtagagacagggtttcgccatattggccaggctggtctcgaactcctgacctcaagtgattcacccacctcagcttcccaaagtgctgggattacaagcaggaataaatgttactgtattaaaagtattagatcctgacccctgcttgatgtgttaagctcagtgtcctctatctgaaataaagatacacactagcgtgttctccagattcaccttaattttacctgaacaatattctaaaattttcaaattatagcacaaacatactaagtacacatataattcacaaaaattaaaaacatatatttagccaaaagtaaataaaataaaatcagtaaaataaacaaatctgagaacttcatgaatggcaaccacagcctaaatgcaaagaaggaataaaacagctacttcttggctcttgggctttcatgggcccaggatccactaatgtaagagtaatttcagagattttgaagggtaactgggtatatttatgtattgtgttatttctttcttttttttttttttttttttttttttgagatagagttttgctcttgttgcccaggctggagtgcaatggcgcaatctcggctcactgcaacgtccacctctcgggttcaagtgattctcttgcctcagcctcccaagtagctgggattacagacatgtgcaaccatgcccagctaattttgtatttttagtagagaccaggtttctccatgttggtcaggctggtctcaaactcctaacctcaggtgatccacctgcctcggtctcccaaagtgctgggattacaggcgtgagccaccgcacccggccatattgtgttatttcatctcacatcttgaccttgaactttgccagttctcctataaatagcaattccactgtagtgacttacatttgaagtttgggcagtttttgataaatatccttattactggattttcttttcaaaatgaacaagaatattggacaactcaggtcctccgtttgaagacattcacagctgagaatgatattcgtatacatctgggccacagactagcagttcatctagttaatcagttactatgtagccaacctcacaagttgctatttactgccaatatgctgcacagctacaagtgttatgggctaaattgtgtcccctcacaagtcatacattgaattccaaacccccagtatcccaaatgtgactgtttggagatagggcctttacagaggtaaccaagttaaaatgtcagcattagggtgggtcttatctaacatgaatggaatccttttaagatgagattcaggtatagacagacacagaaaacagaccatgtgaaggtacacggagaagacatctgtaagcccaggagagaggccacagaaggaatcaaccctactgacaccttgactttggaattgtgagaaaataaacatattatttatttaagccacccagtctgtagtgaaggttcattttatacaagaattatacaacattttactggtccctctcgaattctatagcagcaggcatgtatcagggatcttcacagatattttggagatttttttttttttttttttttttttccgagagggcctctggcatatactcttgacataacatctgggcaccatgggtagtacctcctttatgacagatacttcattttaattaggggatgactgcattatttcaagacaaagcaggtgtaggttattattgggtgttgtatcaaagaaataaagaaatgtaggatgacatggggttattcatttctgcattgaaaataaggggaaataaggagttatatagtaggatcttcgcaattacactgaaaccagtatagtgcgtgcttgttgaatgaatgaatatcagtaataactctcaagaactgtattaagcaccatatttactaaatatcttacatattatttgtaatcatcaaaccacactgataaataagtattgtagcagagacagctggcacctcatcgaaatctgtttcctcctcttccccgacaccagatgacctgatttcccaaattccttaacatttagggttggctacactgattccttttatctgatgggtatgactagaagagatgtgtgccactttgaagccaaagcatgttcacagaagttgtagtgaacacagacagacaacaaacagataaatacacgacaaaatggttgataaatgtgtggcggcgggggcatagatggagagatgggcaaaatacaagttagagacaaactctcaactgtaagctgggagctcacatcctatggtttcaaccacacaaccaaagactacaaaatgcagcgtggcagcataatcaaatttacatcatcaggttttggattgtcaataaactttctagagattactctgcacagccaaaattttaaaatgatatcagatacaacagctaaaattactgggttgaaactggaagcttcctttttaaacagagctgtaaatgtataaaatgccacattagggcacaggttttatcacgtttatttgctagctaattattgaatccaaagcctttccaaacttgtttttggatgttcttgtgtttgtttgtttgtttgtttttcctaaatctttatagccgtgagccttgatcttcatgttttctttctcagaaatcaatcattcctttgtgctacataccacctcctccttcctgatagtatgtaggccatcttcaaactccctacaacttcaccaacatttccaactcattttcatacttttaagcccactggcattatacatgcaatactgactccaataaaatttatcatgtgggattagcataagcagaggtggcaaacttctcatttgttgctcccaaaaacaaaatgctagatcgctctcaagtaagaagaaacttgtatcacagtgtggtttggatggttgctatgacaatatcgagttcttctttgagaaagaccatgataaggcattcattaggaacataagtacctagcagtgagggttgttttctttttcatttttaaaatatctggccaagtagctggcgtttaaacagatcaagcattttacctacattctccaaactttaatttcataacgactccttgaaataagatgatggacaacaaaactggagctcaaagagatgcataacttacctaaagggatatcactggatttgcatccaggttcatcttgtaaaaccacgttgaactgcttaccttgactgaataaatcagcaatgagtacagatatctactttaattaacacatctaaattttgcttcattctataaccaaagcagttaaagggtagaatttggaagcacttaagatgaaccctccaattcttctctattgtctccaaaggctgtcccatctaatggtacagatgtgtgaaactcagaaaaatgataacagattacagatgagacgcaacgaaagcttccagccaggaaggtgagtgaggcagatagacaagctcatgaatttccagaggaacatatcacaattctgatttgtctgtgaggaaaagacatgatgtctccctataaaaattcactgcacattgccaggcatgggggttctcgcctgtaatcccagcagtttgggagtctgaggcaggaggattgcttgagcccaggagttcagaatcagcctggacaacatggcaaaactctgtctctacaaaaaaatataaaaatcagctgggcatggtggcacatgcctgtggccccagatactcaggaggctgaggtgggaggatcgcttgagtctgggaggtccaggctgcagtgagccatgatcatgccactgcactccagcccgggcaacagagagagaccttgctccttgcaaaaaaatcactggacataatgaaattatgaacataagaaaaggttggatttaagggctattttaatgtaattcccatcattttcatcattcttttgtgattcatattatttaccatggaagacttctatttaaatcaaaaggattaactgggagggttacattgataacaaataactagctatcacaaatagaaatttgtgaagggatggaatgtgagaaaattagctttgattatgaaaaatgaaagagaaaagcctaatgtagaattcgcagctaagtgggggcaacccatgccaatcatttcaaaggctggtcacacccgaggcgtgactaacccagcagcagatggaacctggattctacatttcaccatgcttggggtgggcttggggctccatgacccacaattttcccactgcatttcccaggccaaatgcctcaggttctgtcttattccggaatcctgttcatgattagaatcatgctcaagagctaaaatcttcttctgaacttaagccccactgacggaagcactgaatatgcctaactcttacagtttccctccctgcctggaagtgggctctataccaagccaggtggtccagagccactcttctgcccacatcctatcctcatcctcatcttaaatgtagccaacaagaggaaaaacatccattctggttttggctgctggtagtaggcagcggtctaaggtagctcttgagtgtctcactccctgatctgtgtatctgccttctatgagcagcatctgtgactatgaagaatgccacccgtgtgattaggttacactatagggccaaggagaggggggttttcagatatacgtcaagtctgtaatcggctggcttgttcagcaaaagggagattatccccggcgggcctgaactactaaaaagaagtgtgcaagtgagctccatgaaacggggtctcaagttcagagacatgaagtgacagagacttcacgttcctgctaggcttgaagaagcaagtcatcgtaagttctacagctgcaagaaagtgaacttctccgaaaaggacacggagccctcaccgaggcccccaccaaccccttattgtagcctcatgagcccctaagcagaggacccattaaaccaagcccacaaacatggaaatggtgaaacactcacatttttctaccatgataccatttataaacatcggatacatttatcattccaaggattcttgccatttgcagatacctatgcttggctgctgaggaaggctgaagccccttgaggacaaagaaacatgagcttgttgtcatttgatcaaacgggctcttgaagcttaggtcagcagtaccattgtgaagtctgtttttcactttaaggccatgtgagacaaagagatttgttgtggtctgtagggttttactacaacataggatgtggaatatggcaaaagtgtagtttcctacacatgggtttcctaggatggcagtaatcaagtaccacaaactaggggtttaaacaacagaaatgcactgtctcacagctctggaggccagaccctgaaatcaaggcatcggcagggctggttccttctgagggctgggagagaaggacctgctccagggtgctctccttccttgtagatatccaccttccccttgtgcctgcacatcgtcctgcctctgtgcttgtctgtctcactttttttcccctttttctaaggacacttatcatattggattaaggcccagcctaatgaccacactttcacttgattaccactgtaaagacctgatctctccaaataaggtcacattcccaggtgcttcaaaataggtgtttttttttagccaggcatagtggctcatgcctgtaatcccagcactttgggagactgaggcaggtggatcacttgagctcagcagttcgagaccatggccaacatgatgaaaacccgtctctactgaaaatacaaaaattagccgggcatgatggcaggtacctgtaatcccagctacttaggaggctgaggcaggagaattacttgaacctgggagatggaggttgcagtgagccgagataactctagcctcagccaacagagcgagacactgtctcaaaaaaaaaaaaagattttttgaagaacacaattcactccataacgcccataaaagaggaaggagagagcatccaaggactaggtaccttactggagggcagatagccagctgcctctgctgtggcagcaagacaccaaggtgaccctcccaatttcaatagccgtgggatcatcaagggcaggagaaagggaaaggaagaaccttgaatgtgactgcatatctaagtccctaaattgaaacagaatgacctacctggaagtaagagtatgatttttttctttccttctgagagtggaaatgagggcttgtgagaaagttgaaaaatagagaaagtttcatttcagcttatctgagttgtgctgcatgaatatttttattcgcctcctatgtcctgagcatgagaattgagcaccagaggaagaatccaagactccttcactttatccccagtccacagaccgaccattgtcctcagcaataggctgactgtcattccctctcattttgcatgcagggattgtacacgctgaaaaactcccttctgtctaacctcccctgcagcaggtcaagtatagttgtttgctttaatataagatatctgttgtactaagacttcattgaataagtttcttaaacagacgagcaagtcatttttccactcttgagtggcctcttagtgagttaatcattttgtggaaatacaaataaatctaacacaaaatatcagaattttttccttcttaatagaatttaaattctttgatttaaaacatcataatttattccttgttagatttttcaaataatatattcaaatgtccatgttaaatgtcagattaagagacaatgatttttatgagtaattttttatcaccaaaagttaattgcctcatgtatatttctccactgagttagtaatattatgacaatattaatgccgtagattttcaagctaaaacagatctatttttcaaatggaaaattaattctaaaaaaatgaaagtactaatttaaatcattaatggcaatttcctctttgcagactgccttgaacttttccagttctgccctaacagtccaggagaaggaaaatacaaattttctggcatggaaataacataagaaggagctgcaagtttcttggcaaagacattgacaacttttcaggataatcacaaaagggataggataactctaaaaatgaacataatgctagtctgagccagttaagtgctcactttcatagcttctggtagaaagagcattcatggaattaaatattaaatatgttctccgaagttctgagatagtaggataactgtgtgtacttataagaaaggagcgatgtcatgggtgattttcctaaacatagcagagaatcaggaaaacagccaagcatttgctgagacggaggcacataaaacatgaatctgagaatcccaagggtagaagagagaaatgtggagggttatcatcataaatcatgttagaaactagggcaagaaactcatggtgacctctggacactaaaatgcagctggtcataattaagcttcaggctttgctcttcctgggccagttcattggcatcgtctactgccaggcctcgtaccagtctacagaagagattgcctggaacaagcctcttgatgttattcacacttatgaaccaactctggtactagatgcaaaaagcatgtcacaagagggatgggtgggatgggggggaagggacatcgcaggaatcatgccactttccagccccaccaccctctggtgccacgtccacccttgatcactattaccaacccagtatccctccagcacttcacgggagggtgtcagggatcacaaggaaacacatgggacccacacatttcgagatgcctcacctcctgctcgaaagtcaggtgaagaaggattcttgagccaaacatgaaagattttttgagagctaagctgacaggagaatttcccgtaaaaagatgaaagccctggctttaacagagccccttttcatttttacctttaaaaagcttttcctttcatgttaccctgaggttattcaccgctacgacaacaatctccaaagacgttttctccattatagaagaggaaaaggttggcgttgggatttggtcaggaaatgaagcgttgaagacaaacaagatgttctaatatagagcaaacctgatgagtcattttctaagtgagcagccacttccagatacaattcatagtatcttcctagttattactattattattattgtttttttttttttttttctgagacggactttcactcttgtcatccaggctggagtgcaatggcgggatctcgcctcactgccacctctgcctcccacattcaagcgattctcctgcctcagcctcctgagtaactgggactacagttgcctgccaccacacctggctaatttttgcaattttagtagagacaaggtttcactacattgaccaggctagtctccaactcctgacctcaggtgatctgcccacctcggcctcccaaagtgctgggattacaggtgtgagccactgcgcccggcctcttccaagttattctgtcatttggcactgatccgtctttcaaagacattcaattaatcaccagagatgcaacaccataaaggagcagaatatttcaatatattacctgatatattttcttttgtcattacccttttgtaccctgtagctttctaccttaaaggctccacctacaggcagaggctcattgccttagagaaggagagacttaaaaaaaatcccaggcaaacagagggtcaagtaaccagacttggaattgcacagatgttggtgaatctacagcagccacaatggtccaggattgaatctactccatggaagcttcgaagtgggaagagccgaggatgacctagagcccataagaagataagtctgaatcagctggaggaaggtggatacccacaggatgtgtgatggggtctggatgagagcagctgggtgagaagcagcaccactgccttccttagacccaccaggatcagttctttcggtagtgatggagatggggagggggatataaaaacccccagatctctttgattaggtgaaagtaaagcaaccaatggaatgccctaattctttctgggatctcctacagcacacaaaaaaacctgatttccaacactgggtagcagcaatactgtaggtatggccccacagagtgtctatgcacagagtcctgtggtcgctggggacccaaggggtgcagtaaatacctcatgaagggcaaggaggaggtcaaagagactttctgagaataacagtatttccaaagggtgctggctcaaaaaatgaaaatatgtaagccagatgtttagcatcctgggtaagatattaacaagcttcaacatcagatgtaaagggaaggaaaagaaaattgattccacaacatccccagtttcacttcagtagaggccaataagacagaagccaacaggaaattagacttcccttcttcaggcagaacagtggtgaggccctatgggctgatcatccccaggaaaaggatgaaaggataagaagagggaaagaacccgaatgggaaagagtatttctcaaaggggcccaagttttaatttataagattaaaagaatgagggttaaaatgtaaacaaagccaccaaaatatagaaaacacagatttggaattctaaatccatgtactccattcatggaggaggtggaaacttgctgagttctcggaccactcagccagttcacagacataaaaggagacccagcggagagggagtgggtgagtgggagatcaccgccctggagagggcagctgtcccattggggggccccacctccactttttcgagtgctcttcctccacctcaagcccggtggaagccaggggatgactcagagatggggacacagagggctctcctcccagcctgaagagctagagcaggctgtcaggaggaatgtgaatacagtgggtggacctgtactccagggctgtgggaaagactggggttccccaaggaccagatgtgggcaggtggagagacagaaagagagagagacagaggaagaagggagacagagagtgcccgccaccgcacccggctaattttttgtatttttagtagagatggggtttcaccgtgttagccaggatggtctcgatctcctgacattgtgatccgtccgcctcggcctccgaaagtgctgggattacaggcatgagccactattcccggctgggagaagtcttagggcttagacatgagggccacctggagggtggcaggaccctggaaacaagaagccaaagtcaagtctttagggcagcaggagagatcagaaggggccatgcaacccggctgaatagagaggcatcattgggaggcaggagagatgcagaaaagaggtttccagcggtgcaaatgtactaagagttcatgaaagcccccggtgctgaggaatcagctggaacccttggccaggctccaagtacccgagccaaaagctctgtttcctggccccattctcctccttcctacaccctttcaagcttcctcaaacttcttcagagcttggcctgagagagagaaggaggtgaacagagagagaggagagagacagagagagagagagaagcagagactctaattaaacctcttcctcaatgtcaatgtcaggcagagaagaacctgtggcttgaaatgagcaagaaatacaaattgtggaattgattaataacttgcctgaataccaggattagtaaatttagactttgttcactacttcaactgcccacaggactgagtaaaacaaaaatcacagaccctgctgaaactgcaggaatgatttaactcctgcacacgatttaattgggcaactggaaaaggaaatacaaccttttgttctgacgttattaaagatgtgcttgctcagcatcattattgtattaagttttctgctgaagaagattaagaagagaataagaatagaataagagtaaaaaaaaagagaaatacaatacaataaaaacataaaagaaaagaatagaaaaaagagtaagaaaaggaaaagagggatgtaagtaatgcagattcaggtgtaagcacaaactaagttccatctagagactactgaaatactgcactcactttgataacccagaaaacacaggacaagatctgaacgagacctggatctgggttgtgcttcctcgatcactaaccctagtaaccatacttattagctaaaacctctgcctctagcttttcatttggaacatacatttaatatacagccctacataagttcagccaatatgcagctcaacaatatattaactaggcaagttgtatttcagaatctgtgtgagaagcggcatgcacgcagcctcccagcattcgctggtgctggggcttgtgcgtgacaacatcagggagctcttccaaatgctggtcgctcggtacccatatggaggctttcttcctctagattgccaagctttcttaccagaggaagatttaggctgtgtccacttagggccaaaataatgaatcagttcagttgttatgtgtgcaccatttatactggggtttgacagaattttaaactttttactcgattgccttgatatcatggaattattgctatttatcagtctatatttacacaaaaggcctgacatggctacacacaggccctgtggtctgataccacgtaaggcacccacagcatccctcgccagctgagatcgaatttattcacacacatgcgtctcccctccaaatggaacttattctgactttagatctcctattaggactaatgccattaactaattgtccaataatttcagcaaaattcaaagtataaaacggaagtattacctggccccactacaggagttgtgggaacctcactggcaatcagatttttcctgtctgtcttctcttgctcttcacttcccaggaaagcaggcagatccactaacttcataattctagagcaaagtggggccttacacacaagcctacgcttgcccttggagtttattttgacttctgcataggtggctgccactgcagttgtcagaatctgaaattcaggagatgccccttgacaggcagggacaccatctgatggcagtgtgacaaggagcattgttaatacaggaagggctttctaattgagagtggatacccatgcagaaattttcggatgttcccaaggccactacaaagaaacatgaaataaaaagatatatcccatgaaactacaattttggaaaagtaaaaataattacagcaagtttgtatctgggatttgttcattttaaataaaatttaaaaacaaaaacaaagcaaaagagaacaaggaggggagagggacagtaaatgggtaaaaagaaggaaaagatggaggagaaagaccaagagctgtcaaggcccacagtcgccttaaaacagaatgtgcccatccccccacccccttctatgccccccacccccttctatgccagcgcccagtacctcactccctatctgcgctgcctcccagccaggggccttgacaagcccacactctccaggaagggtatgagcacagcctctactgcaggagaggatggagacaagctctgttcttcttgcttttatgtgagtctgatactcatatcactcatctcctttctgagcattgcaggctttaaggaccctctggctggctccttaacccagcttctgaaatcccccggagctgcctgacttcccactctggaccctaagtaaacatttacagaagcagtggatgccgcttatttcttactccacaactatctatccattcttttgccaaccaaattattatgtgccaatcacattgaggtaaagcaaaaatgaacgcactttaaaaacattaaaatgtgctcagattgcaaatgtatacagctattatacccagcaggaaaaaagccaattaatttacgtatttaagaaaattttcttacttgaggacaaaaattaaaaaggggaaggaaactcatgttgaatttcacttagaaaagtcaaagtgaaaataatcagaatgtcttcagctacccaaggatttactgttaactagaaaaaagcatcgtttccatgccacctcagctttccaaatctatcattctaatccatttttaaaaaagaataaaatctgaaaaataaagtacatctccaggcctctcatattgcaaatgacgtgtccaatcatacttctacaaggaaaaaattaatggcaaagggggccaagagttaactgctggaatggttaactagaaaaggcccagtcgaaattaatccccatgatttcatgtgaatttcaagccatagcttaatcctacatgtcagtacaacaggaactgcttagctctgctaatcagattctagaatttttcttttctttttttttttttttgtaagcatcttagtttcgcaaaggcagctggctgtgatggtattggtcactctgctgaagaatatacatgggacctaaaatagctctgggtccttttcaactgtggcagtttcatcaatggcatccgttacaagatcctggtagtaatattgatatatcaaagtaccaattaaaccatctgcacaagggtatccatccacctgtgtctgataccatgtaaggcattctttcacatctggcacaaagaaggaaaaaaggcacaattctacaagattggattttgaaagaacttctgtttgaagagtgaaaagaatagatgtgacatgaatggacagatgaattaggaggcatacagtgtaataacacaaagaaattattgtgggttcatatctaaactccatcagaaaatatattcatatattctgtaacatgaacacatttaatctatagtggttgttctcagagtaacagaaaaaaaatattcttattattaagttcactttcagaaaaatataattaaaaaccacataggacaaggagagacaaagaataaatttccttgaatcatctaaaaataaatgtatcaatatagcaacataccactgtgggctcttcatccttcctgcttcattaattacagtccagtgacacctccatgcccagtcctagctaaaaatcatactctcaacactaaatattaagtctcagattctgacaagtatgttcatgtcagtagttacaacaagcaaaatatgtgaaatcaggattatagctgtgggtgctagaagtggattctctgtcctattattctccattttcacacaactacacatccatccatcttccatctttccgattctgttctgtgccctcagaggttgacacccacaggccaaatcacttgggctcccttgtcctgcaacctccagttgggttttgacaaggggaggtaccaggaggtcaatgggtacagacggaggggagagagagagagagagagagagaaattgactggggcttccctccatccttcctggccctgcttgcttgaaatctctggttccggtggggactgcaaccctctaggatttaccatccaccagatgtcccttctgctagggctccaattctcattagctctgggaacagcatttattcctcttgtccctaaagacctaacaatagtaacagcttcgcaccatgaatagttcaggtgtcttgacatccttctttgttttttttaaaactgttttcttcagcctcctatctgagggtactgttttcttctggaatctgaactgacacaccctggaattacagggttatgtttccctgaagggaagggtgacaataggaagtactaatgaagatatttccccctcaggatgacatatgctctctaatttagtgactctcccacccccccaccaccccccaccccccaaccccatgaggtcagcatggaggca

SEQ ID NO: 1121 - DNA, 158375 bp, Homo sapiens
aggatggacacatgaatacattaaatgaacctcaaacgttatctactatgctctgtgcagaatcagtcagaagacaaggtgtctcgggaatgcaaaacgggacaaagaaaacccagctcaagcaagataagcactgggcagtggttccatttgtctgagcgaggcagcacgtcgagatgagacgaaaacacagacactgactgagtaggtagagcaaggggtggaaatcaagaaccaacaagcagcccagtgcccatctgtgagctggggctgcaggaagaaaagttggaaaggtggctgggtgtggtggttcatgcctataagtccaacacgttgggagcctgaggtgggaggactgcatgagcccaggagttcaagacaagcctgggcaacaaagcgagagcccatctctactaaaaaagtgagccgggtgtggtggcacgcatctgtggtctcagcgacatgggaggctgaggcaggaggattgcttgggcccaggaggttggggctgcaggcagctgtgtttgtgccactgcactccagcctgggtgacagaggaagaccctgtcttaggaaataaacaaataaagtaattaattaattaattaatttaatttaatttggaaaggcaaggctatgttgggagggccctgacatagtgagaggaagtatcattatttgaaggactttgaatgtttctcatgtgactggaaagactattcatattcttaccacagcaagatctgaatttgtgaattgtcaagctctctcggtaacattgtttcattttccattattagttttaagtcactttaaaacaaattgtggtaaaattcaactcctgtcccacgacttagtttgcccacatttaaaactattcctgaaataaactatgtaaatttaggagggaaattttaatctgttaaatgtatttagacatttcctattcagagaaacattatgaagccttctattttgtgtatagtctagatttttaactatgaatatgtgtgtgtattcatgcaaatagtattgatggagatgtatagatagatagatgataggtagatagatgccagatgggtacatggacagtcacacagatggagagatggtaggtggacagactgacactatgaagaaaaacaaagaaggctgaagatggctggggtgaagccatctttctactgggtcttcaggggaaggcttttcgacaaggtggctttagaattactacaagtgaattctatccatacaggaattttgacttttctggagttagagatgatcaaatatattttgaaagaaataaggtcctggtcacaaatatgccactacagagataggttagtcctcacgaggcctacacctccccgactctaaaaatgaacaagatgagcagattgtggaactctgggtttcattcttattgccctttgaggggaaggtgcttagaggtaaatgttggcttggagctgactagaatgaactggttagctttgaatttggtatgcagcacaccatatatgttgagaggttatttaaatgtttttatagtttacatggagagattaattattttatttttatgtaaaaattgctgagatttcagcagttacgatcgctgacctattaatttaagtaataatgtaatgaattttatatttttacatctgcagaataactcacaatcctgtgcaatgtttctgatacctgcctaaatatctgtatttactcattttgcatttcttttcaaaggctctcatgatttcaggaggtatactgatgcaaacttaatatccagaaagaattctggtgcaggaatggtttggtatcaagaacgtgggctccagaggtggacaggtgtgtgtctccaggctaccttgtatcctgcatagctttgagatcttggacaatttatttctctcagagggccacagtttcctcatctgtaaaataaggacagcgatactaagttcagagtgtcatcgagaggataaagttaaagaagatcctggacacacacccacagtgcctaacagcattccatctgcagaagaggtcttggttatttgatgggattgagtgcacagagtgaaaaatgtgtccatacagggaacgtacttactcctttggagcacttatttcatatgtggatcagacaagttagcaagatggtaggtatgctgccaactataacgacagagatatctacacatgtgtagattgtaagattggtgcttctggagcattaataacagatcagaacccgaggatttgttttaccacagattaggatgcaccccaaacaccttctagaatgtccaggctgcttctcactctgttccctaaactctaagaattagctataaattagctattaatcctccattcacatccaattttgtgtagttttaaaagtacaagcatataaaaatagataagccaacctgttccattagccctttaatcaatattttagagaagatgaaaatttgactcacattgtatgtttcacttacaaagcactcctatttcaaggactaaccgtactatagctggtgatatggtttggctgtgcctctacccaaatctcatcctgaattgtagctcccataattcccacatgttgtgggaggcacctggcagaagataactgaatcatgggggtggtttatcccacactgttcccctggtagtgaataagtctcacacgatctgatggttgtataaggggtttcccctttcgcttggttctcattctcttttgcctgccgccatgtaagatgtgcctttgcctttcaccttctgccatgattgggaggcctcccagccatgcagaactatgagtccatttaacctcttttttttttataaattgcccagtcttgggtatgtctttatcagagtgtgagaatggactcatacagctggaatttttttttttttttttttttttttttttttgagatggagtctcgttttgctctgtcacccaggctggagtgcactggcaggatcttggctcagtgcaacctctgcctcccgggttcaagccattctcctgcctcagcctccctcagcctcctgagtagctgggattacaggcacatgccaccaggcccagctaattatttgtgtttttagtagagacagagtttcaccatgttggtcaggctggtcttgaactcctgacctcgtgatctgcccgccttggcctcccacagtgctgggactacaggcgtgagccactgtacctggccaaaaattattatttaacatgaaaagagcacgtatagtatgattttttttaggaaaaaagttaaaactgtctgtcaaaatatagctaatgtgtaccatttagataaatgcaatttaagagaatattatgctggaacacatattatgtgtcttgtgttcaagcacatcacatacatcatccacatgagctgtcccaaagtctgtaagagcagagtcacacactcatttgacaaatggatgaccgaaggcttagaaagttgaggtaattttcccaaatacatacacagcaagtggtggagacaggattcaaatgtgagtcaatgcaacttggagaatttccgtaatggtggttaaggaaataaattttgcctgctgaatagttgtaatgttcattccttcacctctaggctaaccatttcacttctctgcctaaaatctccagtggttccaccttgcatggttgtttccacgtgtgattgactaggcatacttactagtaaaaaatgtgagcacacagcccccaaagcatcttgtttattcacaaattttatatgcattactctactaagagattaagtacaccataaaatacacactgcttagaatttaagaacagatccaaatgagagaattacaatgttgacacgtggttatttgtttttcactattgagtaggaaaccaacgaaaagcttccaatggtactctaatgctggtgaaattttttaattaccgatgacttcaccaaagtttgtcttcaagttttaggtgatttcttggtaagagcgttgaccatggtctcagcctcacactgttagcagtcagcatcacattgcacaacactccctgaggacaaggctcatggttaatagtggtggatatgaattcttatttcaaatagtgcttaactcttgtcagatctgataaaaccatctttttcttttctttttttgcttgttaatgtggctggtgaagtgccttagtatagtcttcaatactatttcattttgtaagagttgctttagtttaaacgaggatcatgtcaactgcaaaacactattatgtgctacaggagacaaatcaatgctggcacacaggaatgtccgcttttcccaaatgttacctgtgaccatcagaaatattcaggcaactgggagtgggcataccatgagcaaagtgaggggtttttcctatttgctttgattaaaaattaatataaatgaaagtcctagtattttattcctgcacactgatggtatgtttcgcatccgttgggatgcatcaactgattttggagcccaggaaaagtctaagctatttggacactaagctgctacttaggactcccagaaaccccatgcctatgctcgcagctacatctctcaatatcttcatcaacatttatttgtagtttactgtgcttacgtacaacctttcaggtcatggctgcactcaagctgagttccctacctagaaaatccttccttcctatattttactcttaatctaaaatttctacattattcctacttatcctgtaaaagtcagattcggagtgattggaagacatttcttccatgtacttgtgagaattaagggttaacttgtccagtactcattcctcagtacgttggcttgaaaaggacttagccttgcaggctcaggaaagagaatggtgtttccctatcaggaactctaaagcagcaagtgaagaggggtggatggatgtggaatgagatgtggacttgtcactctgccaccaggacgaatatacaaaatctggagtccgttacacttgacattttcacacacagaagccatgcatttttcaaggtactatagcttttaataaaagctctttgtgctttgaagagggtgttggataacagtacatatacatacttgttttaaaaaaagaagaaaattaattgaggccagcatacatttttccatgccatttccaactttaacaccgttgaaattcctttaaattcagcttgaggttcccatggaatcacctctggccacgggccgtcaggtacaatcttgggattaagagctctctgtgaagacctggtgaccttgaccattcagggcatttcagattattctaaggcatatttttaaaagtagggttttttcctacatgactagttttgttaaacttgtaatttctttttaacataaatttcatactgaaacaagttaaactgttttttactgaaagtcagcttttgacagaagcgtacccctccctggagaaacagttcttcagaacctatgaatatgtaacaccaatgacttctagcacttttaattttacaaattcccttctaacggctttaattgtaattcctggcataaaagaggcaacaggataatactttgttgaaatgtttaattgaagtataatacatgtatgtcttttatgaaacaacctcaaacttagcattgcaagcacagtacaaataactatttttaaatcaacaaaaatgatatctatttattgtatataatgttgttttgaaatatgtatgtgttgtggaacagctaaattgagacaatatgtgcattacctcatatacttattttttgtggtgacaacaccgaatatctagtcattagtgattttcaagaatgtaatacattgttattaactacagtcaccatattgtgcaatactgtgcaatacatcactttttcctcctgactcactgaaagtttgcttcctgtgaccaacacctccccgcccacacacagccccaacttccagcccctggcaaccagcattttaccctctacttctcagatttcagtgtttttagattccacgtatacgtgaaaccgtgcaatatttgtttttctgtgcctggctcattttatgtaacatcatgtccttcaggttcatccatgttgtcacagatgacagggtattgttcttttaaaaggtcctatggtatcttattgtgtttataaatataacacattttctttattcattcatcagtcaatggacacttaggtaggtccctacctgggctattgtgaatagtgcggcaaaggacatgggagtgcagacatcccttgacatgctggtttgtttcctttggatacgtacccagaagtgagaccactgggtcatatgacagttctatttttaacttttgagctgttttccataatggctgtaccaatttacattcccaccaacagtgtacaaggctttccttttctccacgtccttgccagcgcttatcacttattatctcttgtctttcttgtcttttttttttttttaagatagatgtcgctttgtcacccaggctggagtgcaatctcatctcactgcaacctctccctcctgagttcaagcgattctcctgcctgagcctcctgagtagctggcattacaggcacccaccaccacacctagataacttttgtatttttagtacagagagggttttgccattttggccaggctgctctcaaactcctgacctcagatgatctgtccccttcagcctcccaaagtgctgggattacaggcatgagccaccgtgcccggccatctcttgtctttttgataacagccatcctaacaggtatgaggtaatatctcattgtggttttaatgataattttttccctgataatttatgatgtggagtattttttcatatacctgttggccatttgtatgacttcttttgagaaaagtttattctgtttctttaccccatttttaaattgggttacttattttctaactattgagtttttgagttccttatctattttgaatattaacctcttatcaaatgtatggttggcaaatattttctgccatttcataggttgtctcttcactctgctgattgttgcgtggctgatacagaagttctttagtttgatgcattcccacctattttcccttttgttgcttgtgcttttggagtcatatccaaaaaataactggccatatcaataccacgcagcttttcctctgtgttttcttctgtgagctttacagattcagttcttacatttacagctttaatccactttgggttgatttttgtatatgaggtcagataagggtctcatttccttcttctgcttgtggatatccagttgttccaacaccacttatggaagagacagtactttccccgttatgtattcttggcgtctttgtcaaaaaccaattgactgggccaggcgcggtggctcacgcctgtaatcccagcactttgggaggccgagtcgggcggaacacgaggtcaggagatcgagaccatcctggctaacgtggagaaaccctgtctctactaaaaaaaaaatacaaaaattagccgggcgtggtggcgggcgcctgcagtcccagctacttgggaggctgaggcaggagaatggcgtaaacccgggaggtggagcttgcagtgagccgagatcgtgccactgcactccagcctaggcaacagagcgagactccgtctctaaaaaaaaaaaccaattgactgtatatgtgtggatttatatctgagatctagagatactataactctctatatctctagagatactctaactatgtggtatatattttaaggcaggtagtgtgatgcctccagctttatttacataactacttttgggagtaagttgctgccatgatgctccatcatccctgaaaactttactgtgtatttcctaaaaacaagacattcttctacacaattggtccattcaccaaaatcaggaactcacattgatacactattagcatttaatccacaggcctgatgtaagttgtctcaattatgttctttcttaccatgtttttcatttttctaattttctcttttttaattttaagttccagggtccatgtacaggacgtgcaggtttgttacataggtaaacgtgtgccacggtggtttgctgccccatcaacccatcccctaggtattaaacccagcttgcatttgttattattcccaatactctccgtccccccacccatcccccagtaggccccagtgtgtgttgttcccctccctgtgtccctgtgttctcactgttcagctcccacttataagtgagaaggtgcggtgtctggttttctgttcctgcattagttatgcaccagctaagactatgccttgcatttaggtgccatgtctcttttggtcctggctacatttgcatataggaaaacaataacaattaatggcaatcatcaatactttcctctatctagttaggttaatctagacatggtgtataaaaacaattacattattaatcttaaaagataagtaaagcgctcatgaaaacggggaaactgatacataaatattttcttcgactgctcatgctgcattctggagacgaccttcactattttttgcacaaatatttgaaaaacatacgcaggtattttatctaaaagatccatgccttcttaaagcatgaaagttggaaaagtggttgtgggtccaccaaactacaaagcccaatttctagaagaaatagagggcatggcacactgctgatgaagaacacacagggcagaaatacataacttgcccgggcgcggtggctcacgcctgtaatcccagcactttgggaggccgaggcaggcggatcacgaggtcaggagatcgagaccatcctggctaacacggtgaaaccccgtctctactgaaaatacaaaaaattagccaggcgtggtggcgggcacctgtaatcccagctacttgggaggctgaggcaggagaatggcgtgaacccgggaggcagagcttgcagtgagcagagatcgcgccactgcactccagcctgggcgaaagagcgagactctgtctcaaaaaaaaaaaaaaaaagaaaaaaagaaatacataacttgaatgaaaatgtgtattagctaaaataaaatggttttaaaaaaaacaggatcagagggttttataagtgagttccactaaactctcaagtaacattccaattccttcatgtttaaaaaaaagaaaaagaaaaaaagctgttcagttttgtttaaattaatttctaaataaaacaggagcaataaaagaaaatgaggatgaaattccatttcacttgtaagtatacatatgaaacagaatccaaataatatcccatcatcaagatttatctcaagaatgtgaggatggtttatcatctgaaaaatccccatcaatgtaatttaaaataggaagaaactgaaaggtaaagcacttattatctcttataatacggacgcaatgacttaataatagtccataactttactattaaagcaaacagaaaagaacaacagagtaaaccaggaatggaacagaagtctctaacttgataagggcaatatatcaaacattgcaaaaatatttaaatttctgggagaactcttagctacattttaacttctgaaaaaaaaaaaatagaggatgatatcagcaaacaaaacaaactccagagatgagaaattgaaactagcactcagaggaacgccagggcagtgggccttctgagcccagaaaggcccggattcacaatgaagggacctagcctcagacggcagatgagagtggcagtgtttagcactgtcccttaggagatgctcagtaaaatgcctctgccagctgcctcctcttcctcacctgtatgtagctgtgaaatcctgggcactgttctcgaaagagcataagatgctccgagagggtcggccttatacgatttaagctgggccaagagggcaagtggagtctcaggggatggcagcctgtgctgtggaggtgagggccacagagcaaagcccctccatgaagggctcaaagcaaaggagaggccttctgcagtgcggccattaagatcatggtctgggaagccaggctgcctgggtttcaatctcagctctaccacttactgcatgactcagtttgtttgtcttgtgccctgcactcctcatctccatgaagagctaatggcagcacctacttcaaggttggttggaaggggtgaatgagttaatccaggtaaaacatgagaacagtctctgttcttcctcaagggaagcctcctgacgcctgaacacacacattccactggtgtatttccagcacaagattctggtgtgcatatgcctccaaaatgcaatagggaatctatgtaaccttccaatactaattaacatattgtttggccacacatattaataaacaagcaggaatcatctgattttggaggtaagtaaataacatgaaaaagaaatgccaagatgcacaaagacaacaactaatcatattaataggactgtttaatggaaggtacatgaaagaagaagaaatcaaagaaccggtgcttctcagactctgacgtgcaagtggattaccaggagatttgttattaataaataaataagaatgaaatgcagcctgcatcagcaggccaggcgtggactctgggattcagcatttctcaacaagcccaccgtgtaacaccaattgttgctggtccacgttccacacttttaggggtggggatcaaaaagataaagtcaagaaatgtttcaggagtaggaggaaaacgacaaaaatatacaaagaaagagatatttttaaagtaaatgcaaaattaagaagtaaaataattctaataggcatccttaaagaagatggcagaaatcagagaggggagaatataattttaaaaataaggatattttcctgggcaataaggataaaaggactagttctccatgctggctacatgctctgattttgggtggcatcaaagaataccaattgtttggccataatctatggaggcatagcttacgtatctgtggtttttaaaatcatagtgaagtgagaagcactcatcacgcattagagtaaaacagcccaaagggtatgcagcgaaaagaagacagaacccaccttgacatattttatggctctaaacggggatagaaaatctgagaggttttacaagaaatataacacctgaaacctacatatgaaacaaatgcccgaattgaattcaccttctcaatagtagtgccaagttttagaagagcagtgccttcaaattgggagagaaatgctataaacacagccaaaccacatcaaaataaagaatggaactaacaaataatgccttcaaggagaaaggagattatatgacaacaaattctacaaatataaataaaatattcattttttaaagatggagtctcactcttattacccagcctagagtgcaatggcgcgatttcggctcactgcaacctccacttcctgggttcgagcaattctcctgcctcagcctccgaagtagctgggactacaggcgtgtgccaccacctggctaatttttgtatttttagtagagatggggtttcaccaccttggccaggcgggtctcaaactcctgacctcacgtgatccacctgccttggtctcccaaagtgctgggattacaggcatgagccactgcacccggcccagatattcttaactataacataaaggcatatgtttcttccaccaataagaaaaataaaaatcaatttctctgagaacaatagagcagtaaaagaaaggcataaatctgaaccaaatatgaaacaaactaaaatatgataagatttttagtaactgatatctcctataaactctgaggtttggaacattattaatgattagtacaggctgagaaacattcaaatatcatttctttctcatggatccaatcgtcatacatacttgcccggccacataatacaatcttataaaccttgtcaatgtaactgtattactacatctgacagaatttaggaggagacaaaaaagtggtgaaaaatgtggatagaaaatgattggttgataagttccatcaaagtttgttgaatacatcagagttaaagtatgtcgttcaaagtaacaatgcacttgatgattacagctcccgtaagtacgggaagaggatggatagattaacaatgggaacaggctgggagaagagatgtggggcaaagaatgccaaattattaggttttcaaggtggggggtgaatgtgcatattttaatgttgataaatcaatagctccgcgatgatgataatccccaaaagaactaagtggagaaacacgtacaagtggctaactctggggaacagaactgaggacatgagagagtgaattccttttttttttttttcattttatgaagaaagcaggaaagcatgtattacatccataattaaagatattttaaatggtaatacaaccaagcagttgaaataacctaaacatttcaacttcattaatatctatttttaaaagcattttgaatcatctgtttctcttagatacttcttcattttacttaggaggagagcagcattctatcgtcatttcttctgggactttgcacaaatcagaagatttgcacaaggcaatactgtggcagcacagaacaactttaacaagttcacggaaaggaaaaccattcacattcgaaatagagctccatgcctctaaccaataccttcccctggcatatgtctgaccttgtcctggggactgaactagagtcatttcctgtgttactcaggacacaagtgtcacgatgttgtatgcactccagtcttgactgactagcccagaagggcaaaaaggcaatgtgaggggcttagtcttgctgcccagccctcactgttcactttccagaattcttatggtaggaaaatttctcagttcaaaagcttcaggttacctgtgcatttgctctttcaatacacatgaggagctcggtgtcactcaacctatccgtattccccatgctccaagagtctcactcagaggtgagcgtagggttagaagaaaaaaatgggaacagttatcatttaaacagtttctcacaacccccatcaggtacaactcttgagtgagtaccaagattccttgcttaaaaataaaaggttgaaggccgggctcaatggttcaggcctataatcccagcactttgggaggccaaagggggcgcatcacttgaggtcaggagttcgagaccagcctggccaacatggcgaaaccctgtctctactaaaaatacaaaaattagccgggcatggcggcaggcgcctgtaatcccagctactcaggaggctgaggcaggagtatcgcatgaacgcaggaggtggaggttgcagtgagccgagatcgcacctctgtactccagcctgggcgacagagcgagactctgtctcaaaataaataaatgaataaaaagttgtaccaagtagtggctaatttataaagcaaataactaatcttttaaatgagagagaacagaagagtttctcattttggagattaaagcatggcccagtcagcaactttataacactgaccaggagaggtacatgcctttgttaaccctggctgttgttactgttatatcactagggtgtctcctcaacaacactgttcctttttctcttttcctgttgctgtgaactaggcatcaggcatagttgtgtatgaagttatcaggaaaatcacaaagatgtgtctaccagggcaggcaaaccccagatcctaaggtttctgtccagcttttccataaacttttcctatttcttactcccaagtttgtcaaaaaacaccagtctttgactttttctctaaatgaaaaccccatagaatctaagttccaagcccaaaatttatttgcaaaagaaaggaggaaggaatgaaggaagaaggaaggaaatacatattatgtctatttaatatacactatgcacttctttaatatattacttattacatatggatgcatttttatctgttcattcaagaaaggatatgtcaaatgcctttgcttgggaacacctacgttcagtttgctccaaacatgtacctggttttcaaacgtcccacactcctgcttcacagggaaagatttgccattatgcttagtggtgggaatctatgcaaatggttccacatgccaatgccaagccaaaagagaaagacaagcctttgttccagaagacacagccctttacagccctttgaatccattcctctgggagcttccccatgggaggactgcttctttctgtgacccagcctcactaaatgcactaggaatcagcgcacttcactaaatattacatctagatcatgtgtgtatttactataattatgcatatttcatctgaactaattttcagaaaccctttccttagcaaatcgcacattttacgaaatgtcagtgtttcctaccaaccaccatgaaaacaacaacaaaagctgaaacatagcaggaactcaaatcgcagagtatttcaaatagataattagactgaattctaaagttctctaactaccatatatgtaatattaaaaaggtcattaaattgttggtgtgacagggttagttaaacataggcctagcagccagtaaagatgctgagtgcagtgacaaagaacggtgaacggaggacctgtttgtgaaggatgaggattttcctgcattcaccgttgagaagtcagtcttcataggatggtgctgagtaggactagatagatttaatcaccatcacaggaacaaactcactaattatagtagcagtgacacaggacaggtgagacccacaactggggcttagctgaggagggttcttgactttgcccaggaaggaactgaggggtaagtcagtggtgttaaaaagcaatgtttactgaagtggcggtgtacagcagcagcagcgctgccccgtaggcagtgtgccagggcagcagctcagaggcagcattgcatccatatttatacccacttttaatttcatggggtggattatgaagaaatttctagaaaagggtcaccaagttgttgtcgtgaaaaggggcagtaactcccaagtgttgccatggcaatgggaaactgacacagcaccctggtgggtgtgtcatatggaaagctgcttccagcccagccctattttagctagtcctcaatttggtccagtgcctgagccccacctccagagttgacttccaccttctacatcagtaagacaaagaaagtcgcaaagttggaagaatatacagagagagataaaagctgtattcaggaagtagatcctttataaaatccactagaaaatacaactgacttagtaatagccaatgacaaaacactgcatgtgcagaaattcaggactttatacaagtaataatgagtgaggacgcaaggcagccctggccaggacgatgaggggcagagatgatacagggaccagctatggctcttcggaccctgaccaaggaaggaaagctacagatgagtaaacagagttgactccatgagctcagcagaaatagggtgtttgtttatgtgtttgcagttttcaccagttcttagtgagaagttaggagttacagtgtgcactcctctgctatttatagtctgatatattaatacaggagctgtcttggccaagctcttcctctctacagatgctgtcccttaaacactttccaacatccaatgagcacttatacaaagattgctttttatttcatttaccgccttctcagctgtttatgagtcaaactgtttcctggtactgttgctgtaggtgtatattggacattactcaggatctgaagcatatacaatatccccaagcttaaattagtcattgtttcacttgtcaaattcaattaacatcatatgccaattgcataccatgaatcatttagtaaacactgtctagaaatattaacataaatcctgtgttttacttaacactatgttgaattctgttcataagtttgttgtttgcaacagtttaagttttagtcaatttcaaaattcttttgaatgtactatgtgtgtgtactatgggataaaagaaataaattaatatattgatgtttacggtaatgtgggttctcactatgggaaaaggtagatatgaatactgaaaggggaaaggcaatagataattctatggtattcctgaagttatatgaatgaactcattaatgcacacagacacacatacacatattctaccatatagtaaaatggtctagaagcaaaaacattggtagcaacgtttatgtctaaatgtaacagccagatcctagggtttggtaaatagaagatgaacctggaacttctgtgccaaaaagcaaggactcaaagaccaatgtggacatatcaaaactatgtaggagctgatttaaaggggttcatttttctcaaactgttctttaaagaagaatgctaaatggcaaatgtaaacaaacaatataattataaatctttctggttttttggaaaccacaaatgcaattatttatttgggcagaaatagaaatgaatccttaaaaagaccgttgaagaatagcatcttgacatggtctgaaagcagtatcccacatcttgtctactaattgcataagaaaaaggcaaccttgaaacaggggcgatgtccttttgagtatgaaactcacaagggagagactttatcagatcagatgctagtggggatcacaaacgccaccagatgagctggcgttctgtgttgctgatgggatgtaatgtaaagtacacaccctctaggaaacggtcttgccacacatgcttcacctgaacataccatgaggaaaacggcaggacaaatccagattctgagacatcccaaaaaaggactggcctgacgtctttaagtatgtcagagttgagacagacaaaaagtggcaggaagttgtggctgacatgaccagaccgccaaatgcaacgtgtgggcttcacctcaaccgggagaagaaaaacagatgtccacagaagacgttcggagatggatgggaagatgtgcacaagggctgcccatgaaataatatcactgagtcaacgtacaggcatggtgatggaacaggatgactttgcatttaagagatgcacgctggctggacacagtagatcacgcctttaatcccagcactttgggaggccaaggtgggcagatcacgaggtcaggagatcgagaccatcccggctaacacagtgaaaccccgtctctactaaaaatacaaaaaattacccgagtgttgtggcatgcatctgtagtcccagctactcgggaggctgaggcaggagaatggtgtgaacctgggaggcagagcttgcagtgagccgagactgcaccactgtgctccagcctgggcaacagagtgagactctgtctaaaaaaaaagagatgcacactacaactttcaaacaaatccaccaacacacacgcacacacggacgtgcacactcacatacatacacacatgtatcatgttttgtgtgagtgcggggtgtgtgtagcatgggtatttgtgtgtgagaaggaaggcaagtgggtcaaaagataaagaaatggtgcatagagtaaatcactgcggtactgtactagtctttcaagttttctacagtctcacaattaaaaaaaaaaaggtggagaaaaattttcctggagagagaaactaaacaaccagaagtttctgatgattgaattaaatcgtttttcagtatgccaagcctctgagcagctggattttccacactttagtttgttgccctggggcctcccagtcttgcttccataactcaacagaattctaccaccaattgttgaatccaaagtttcgttccaaagtctctgaaagcagaaactgtgttccagatacagagaatcaaaatgcgctactgaagtcatccagaatatcagtagccaagacatgatcagagagacctatgaatctaagccagttttctgatttttaagccaaattgtttatctccattcaacactctcaatacttgtatctacaaacatattggactaatgcagagagcacatttccacactggaacagttgaatagggatgtgaaaactcgaatatctttgcaaccttcaaacaacacttgacattaaaaatccatttacaaatccagctttatgctaaatattgtggtaacattcttaaagaccagacctcttcatgtggaaaatgatgtcccagtctaaagttttttgaaaggatttgctatgaaactgataataattttataggtattcatgtctatacaattactaggactttttttacacagaatacctaagtttctcctaccttattgaagattcttattaaaataccacatattaaaaaagataaagtaacacaaaaagtcacaaaagaattgaagtttacttttttgctttatttggcccaacacagtgtcttctagaagtccttgtcatcacaaaaatataaagcttcctttggatatgcactccccaacctgaattgtaagcactttgaagacagtaattaggtcttccatcacactttagataatgtcctaggccgggcgcagtggctcatgtgtataatcccagcactttgggagtctaagacaggaggatcacttgagctaagacaggaggatcacttgagccccggagttcaagatcagcttcagaaacatagtgagacccccatctttacaaaattaaaaaaaaaaaagctgagtatcgtggtttacacctgtggtgccagctactcgggaggctgaggtagggaggtcaaggcggcagtgagccatggtcgcgccactgcactccaccctgcacaacagagcaagagcctgtctcaaagaaaagaaaacacaccatgacgtcctgcatatatctgcctctcagagaactgattcaccgatttcatcgtttaaaaccaatgcaatactttcattttcatgaaaatggaagcaggctttcatgaaaacagtcttcaagttcatgttacacaaatcctacagaaattgtggacaaatgatctgacatcctcctataaaaggatgagaagaagctgtgcctcatgtaactgatcatttctatgtattaagccatatgaaatatcatgtctttgctgagcagaggctacaattagaaaagacccgatctaaaagaatgctcaaaggtcatcaagcatgattacattctgctgcacactgtaaaatgcatccaagtgtaaaggattattcaacaaattatgaatgattcattcatggcagatttttcattagaaggtaatgtctcctttcccataaagtcaacattatgatccaggatgccatttattagaacttatgctattaaacaagatatgaaaagagaatcttcttaagtgtctcacatcagttaaattaccctccacctgttggaaataagcactgtggtcaatgaagggagagggatatgtagtacatgtgttacaggatttgcaagagttatgcttatgtatatgtatacatgtacacaattttcattactgatctttcacttatgtctgaaagtcaaatacttactccttttgcttaaaattttggactctaaattatcccaggatcggtagttaccccaggacagcgtagtagttattaaaaagtcaattagatcccatttgtcaattttggcttttgttgccattgtttttggtgttttagacatgaagtccttgccctgcctatgtcctgaatagtaatgcctaggttttcttctagggtttttatggttttaggtctaacgtttaagtctttaatccatcttgaattgatttttgtataaggtgtaaggaagggatccagtttcagctttctacatatggctaaccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagcgtgatgcctccagctttgttcttttggctcaggattgacttggcgatgcgggctcttttttggttccatatgaactttaaagtattgttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctcctcgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgaatattttcacaacctactcgtctgaaaaagggctaatatccagaatctacaatgaactcaaacaaatttacaagaaaaaaacaaacaaccctatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaacggcaatcattaaaaagtcaagaaacaacaggtgctggagaggatgtggagaaataggaacacttttacactgttggtgggattgtaaactagttcaaccattgtggaagtcagtgtggcgattcctcagggatctagaactagaaataccatttgacccaggcatcccattactgggtatatacccaaaggactataaatcatgctgctataaagacacatgcacacgtatgtttattgcggcattattcacaatagcaaaaacttggaaccaacccaaatgtccaacaatgatagactggattaaggaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcatattcttactcataggtgggaattgaataatgagaacacatggacacaggaaggggaacatcacactctggggactgttgtggggtggggggaggcgggagggatagcactgggaaatatacctaatgctagatgacgagttagtgggtgcagcgcaccagcaaggcacatgtatacatatgtaactaacctgcacattgtgcacatgtaccctaaaacttaaagtataataataataaataaatacattaaaataaataaataaataaaaatttgacatgtttccaaagaaaaaaaaaaaaagtcaaatgagattttaaaatatttcccaagtgttatctgagagatcactttgagagaaggaaagcaagcggtgtttgtcatgagcttcgtccaaatcagaggccttgagtgttcggaggatcatctaaacccatgaaaaaaatcagctggcaggagcccatatgggtcaagatggcttctggagatagataaaagcggatgtctgaagtagactccctacttcccagctgtaactggcagtagagtaatcttgctaggaccaaatatcctttggtactgcatacatcaatagcactagctaaaaagattgatctgagttatccatttattttagagtttaaaatacactctccacagcatcttttttccactgggaatccagagatgttttacttcccgtctctataaaaagccgcctcacaatttacagggccactgcccactcttcatactttaaaagatatagataggaattcagaagaataagaatccctccttatttgcagatcaaatttacccttcagcaaacttcatgggctgacacattacccttgagcagggggtatagatatacaatcattaagaataatcaccaaatatttcaatttacttgatttaacaagcttttaaaatccattgcaagggggtaaaatttgattaataaactgcaggccacataaggatcttgtacaaggtgacttatttaactgactccacagaaaagtcaacaagcaatccattgatcacaacatgcaaacaattcctacttgagtgtcccactggcttagcggcagatttgggtctcaattgctgatcaatttctgcattatgattctggcatgaaacagctctctaggaaagggacgacatcataaagatgtgtataagagaaagaagatggctgagccctggcctcacggactttttgtcacgcccttttcaatcagctagaatccaatctgataatcatttactgtgtcttaagggacgagagcacgtgtgtacattagatcctgtatacgtttacgctgcacatttagattgagtgtgtactgtgtgcctgtcactaccataagtcactatgggttcagagataaaacaaatagctctatgtaaggtgctcacagtctagacaggcagagaataggaaatatagaacagcaatacactgaaataagtgaaattgcagagatatgcacaggcgtgaaagtcatttagagggtggagaacataggggagttttgagttgactgatggagctgaaatatgggcaaatgttggaaaggaatactttgcaccagactgcaaagatcaaataataacaaattcagggatgtgtgttttagtctgcttatattgcagagggactgaaggatttttaactgaatgacagcatccattccaaacttcatcagacaacaggatagaaggcagagtttcagctcagtgaagtatgttttatcaaactgtccaggatggtttctgagtaacacataaaaatgtaaatcactgtgggaaagcagctgtaattcacgatgacataaaaaccactttaaatcataaacacaaagcagggaaagaaaaagcttcttaaagtgggaagggagagaaagtggggcttaaaatagataatgaagaatgattttaaatcttgttatgctggcacgtaaatggttttgcatcagacaattctagagaaaggtatgtgattccaagtgggagtcatgttcaggatgagatacccaagcagtctgacatatgcttgcagtctactaggcgtaggctttcgccgaagggcctaagcctaggggaggcttaatcacagatcccacgctgtggccctttccctgcatcctggccatgtgaactatagtaaaagtgaaattgtatgagactgcgagaaagacctatgcatttccaagccaagtctccctcagcaggtggggaaaattggggggaaggtacagaccatgtccctgtaaaggctgctcagtaactcctatgctctgaccagctcttgagatggtgtcagaacctgttgatttccttctccactgcagcttgattcatccacactaatgcagttctgcacgaacaacagcctcaagatggaatcccaacacaggttccaggctccatcctttctggagtcaggtttgaggacaagccttttacctctatgcacagagagaaacatctgagtgaatgcaactgatggaaatcaaatatttaaaagtaaacatttttgggccgatgtggtggctcatgcctataatcccagcactttgggaggctgagatgggtggattgcctgaggtcaggagttcaggaccagcctggccaacgtggggaaaccttgtctctactaaaaatacaaaattagccaggcatgatggcacacacctgtaatcccagctaattgggaggctgaggcaggagaattgcttgaacctgggagacagagcttgcagtgagccaagatcacgctgttgcactccagtctgggcgacaagagtgaaacattttcattaacatttcaaattttaaaaatgagtatgattgggccgggcgcagtggctcacgcctgtaatgccagcactttgggaggccgaggcgggtggatcatgaggtcaggagatcaagaccatcctggctaacatggtgaaaccctgtctccactaaaaaaaattagccaggcgtggtggccagcgccagttgtcccagctacttgggaggctgagacaggagaatggttgtgaagccgggaggtggagcttgcagtgagccgagaacgcgccactgcactccagcctgggctacagagcgagactccatctcaaaaaaaaaaagagtatgatcacattaaaaagaagtaaacatttcagcttagagcatactacatttttaaaattaaatgcttcccctagttttcaatattatacatgaatgtatttgcttcatttttacaaacacatggcaggtatacatgaagctgtggctgctcagtcaatgccaagcaaaaggcctgaagtcctaaccttgaaatgcccaatgatgagttaataaagtcagcaacattaacatgtgctcttttacagccaaataaccaaccacaaccaaaagagtatttaatatttgctttcatttataaggtaaccagtgcattacaaaaaagttaaaaagcctacgattctctgaataacttggaactcctataagcaacacttgacaaattagcaacatgggcgtggaggtgtcctggcctttgaacacgaagatgatgatgtcttccttgtcatgctgccagtctagagcacacatagacttgcgtttctaattatgataataactcatctggccacatccacagatcatcccattgcatttgtgaccaacagcacacacgttcaaaatagctggttgaaatgaggtatgcctattggttatggaataagcacagggaagtgaactaatcagatagatattatagtagtaagtgagggtgaatttctacttcagaatagataccttcaaagatttcctttaacaagttcttgtggatcctggtagacccaaagaaaaagcacactttttcttcttagaaaggaagtgaagataccttattagttatgagaaaatatgacagactttgttccaaagcactgcaggaagtgctcggtaatcctgcaattggcacaaagtctacagggctttaaatcaaggggcctcgggatgatcagggaaaggactgtgaataagctgccaacctgtgttttgccttgaaggctgggcagggctgtcaggtactcagacattttctctcacctccaaactcttccacactctgctctggatgctatagacacaactgtgccaactacttttcccaaaatgttttgccagctggatttggtgagctgtcaacaggaggcaggaattcacaatgcaggagaagaggcaagggaacttccttattcctgtctgcttgcggtttgtgtcagcaaaatcacatgagctcaagttccccagcagtggcgcgctgtcccagaagcagctgttttttcccctcctctggcttcttttgccacttccaagaacagtttatcttgcccctctaaggagccagtggcaagcgggtctttaggtaagaagccttgaaggaagggagaagggctgctttctctgggaggggagaatcagagagatttggaaattcaaaatcagctttgtctgaatctatttagatgactccagtctcagggtccaatatcttgccaatcactctgactttcacacacaaggctgtttgaaggttcttgaacttaattgtaattctgtaacattttggatgttattttctgcaactcagccctatgactaagaggggagaaagttatcattatctttttagttcttcaggccaaaatagaagttctctgttttgttgttgttgttcttgttgttatttcaggtagggtcttgctctgtcatccagactggagctcagtggcgagactgtggctcactgcagcctcaacttctcaggctccagtgatcctcccacatcgacgagtaactgggaccacaagcacacccagctaatttttatatttttttgcagagacaaggtttcaccctgttgctaaggctggtatggaactcctgggctcaagcaattctcctgcttcatcctcccaaagcattgggattataggcgtgagccactgtgcttggcccatttattttttataaaaagtatcccgagtttatgatttcctatcactagacttctagccatttaaccccatagtccttgtcatcatcatttctatcatcacaggtaggtattgcaaggactttcacctaataggacaaccatgagctggagtaagggaaacatacatttctgctcaggattatcagctctgaactgcaaccaattcatggtaactaaaactccatgttggtcaccaaagtggaggcttttggtggtaaggtgataaatggatgaggcccacgtctattttacggagattgcagaaggttcagaaatgcatcacttggttatttttctagttcctgaatatgtaattagaacagacatttgcagcaactggcagaattcctgcatgtctctctgccccctggtgtgagcgatattaaaccagagccaggaggcttctaaaatatgaccttcctaccagaggatgttaatattgctgggggaagggcaacgattaatatctctgtcaaagatttgaaaaaggcaagtctcatctacttactccatactcatttaactcacctgtttggcccatgcacaaagcagttggacttagagaataattgtgaattaccataaatttacttagcttgtgattgcaattgcagctgctcttccagatatgatattttcactggaacaaataaacacagctcctggcatctggcagtttacaccttttgatcaggcaaattaattcatagcaactttcaaggatcaccaaaagccatttgcttttgcttggtcgggtccacatagcacctgcacttttctctgggtgatgtcaactctcctgctctttgtcctgactacatttgcagaaatgttgatcatgcttacctcaaactaactatactgacaacatgtaccacacagaccagatgaacagaaaatagcaaataccttaaatgtctgaataagatgtatgccaacccgtggaaaataaagcccatgaaaatgtaggcaccatcattttagtgaagttcttgggggttgaatgcttccgagcatgtgaggatataccctccaagttaaaaggtgagtttctggaaattgcaatgtgcttaccactaaaaaagaaggacagtacttgatgggcctccttgggcttatatgtcacttgtactgctttcacccatttatcaagaaatgtgtaaggctaccagttttgattggagtcttgggcaagagaggactgctgcagattcagatggcagtgcaagctgctttgccttatgacaagggccttatgatccaacagatacaattatatgtcaatgtctatgacaaacagaggttctgttgtggttagctgctgggtcctgatacagactaaacacctcattctatgaacataaagaaaccatgtggggtggccatgatgaaggggatgagagctggcctgctgcatctctgctggctcagctcatacctgtggactcctaggagagagaattttgaccaaatcacataggaatgaaaaacctcaggccttatttacagatgagcagtacaatatactgtcactaaaacactggttgatgcagcatgtggttatttacttggtcaagattgagacagaagtataggaaacagtgattatttggtgatcattaggggtctggttggaaggtaaggggcttggaaagaatgggattagaaggctgaaaacaaattgttcttactgaatcctcaaaactgagtctccagtgtgaagatatctgcactccatagaaatgctctctcaagggggttcactgcagaggaggctgtcagtaatcgggccaacaagacgacatgccctgtgaatgtcatggagcctctttcctcagcctctcctatttaccagatgaatcctgtggcaaagacagagctatgcttgggcagcatacaacctcctctcgccaaggctgatctgctaccaacactcctgtgtgctcatctcctgcagcagtgagtgctcagcatggaacagggcacagttctcccagaaggggcctcttaggagtgggttgattactttggacccttacattatgcaggaggcagcaaacggtcctcgctggaaaaggcatttattttgggtatggattcatcattcctgtctgccttgtttctagaaaaatcattgtccacaggtttatagaatatcctagtcacgatatggcactcacacacatgcttcagaacaatgaactcattttgctgcaaaggaagtatggcaatgggatcatgtctgttgatttttctcatattatcaagtctcccagaagcagctgggctgatggactgctgactgacctagaaaagccttagtggtggtgtcagtaggtgacaacatttggatagcctggggctcaatctgttctatctatctatctatctatctatctatctatctatctatctctgatatatatttgaattcttatatatgcgctgacccagcaaccaatatatggtgctgcttctctcactgccagaaaacacacctgcagaatcaactggatgatgtgggagtggctgctttcactactatatctaataacccattcacagaatgtttcattcgtgtcttctcagctctgggctctgctggtttaaatgtcttcgtacccaagagggcaaggtttccaccaggagaaacaaaaatagttaaaaaaaaaaaaaaaagttgagactggtacttgcccattttgagttccttaaacactgaagtaacaagaaaaaacgggggatactatgttgcctgggatgctggtcacaatttctagggaaaaactgaattgctactacacagtagtgagggagagaaatggatctcatttacaggggaattcctgtggcagctcatggtatttccatgtccaaaagtacaagttaatgaaaactatggcaaccaataaagattaaactgttgggtatttagagctttcaggaatgaagatttgggtcacattatacaatgggaaaaaaaggcaacctccaaacagattatggctgaaggaaaaggtaatagaagaggaactgtagaaaagagatgttataaacaaatataaacttatcagttatatgaatacagtgtaaatataggtatgtatatggtaactaatatttcatttcttctttaccgccactagttacttatatgtttgtaattttgtggttaactttatcatttaagttattctttaggttataagattctgttgcaagtaagaagaaactacaagagaaattaacatcttttagacaaggatagtatgatggttggaaattgtgtcttccattgctcaggagaggccaagagagtgtttgaacgaatagttattttttattaggtatacccatggagtatttactgttatgaaaaggaagtttgagtatgtgcaaagcagtatatgttctgaaaagatatggtcagtgtggacccaaagggttggtcaatatgaattacttaactattgtttctaacatcaaaaccctccatttgtattctattctctaatgttttgacattaaattactcaaaactcttaacagctagtttcttgttagactataccgagaggaggcactagagggagactggaaaacaagaggaagggagaaggggcttttcttcttcctgttgagttgattgccctgtaagtatcactctggcagcagcacacaacccgagcaacaattgcttctcccagaagcagcacttagtccaagcaccagctgttgtttccagcctctagttagttttaagcaaggagaactagcctcatcatgccattttgatgatccaaacccagctccgagaaaagtcccatctgtgagctttcagattctgacaaacctactctcttccacttcctttcaccaacaccagggctggtgggagcttcttactgttagcatgtctcaattcccttaatatttcatttttgcttttcagttttctaactctgtgtaatgaattctctacttaaaatttcctctgcaaaaaaccagtgggatctgtctttccctcgctgggaaagggacagagcagggttttaatcagtgaggttgggagttcactacactacattaagtacaaagttgtaaagagcctaagccagggatgaataacagcagacattaagcaagaaaagcccattgagctggaatctgatttgaaatgcaattgaaaagggagaaaatcaaagataaccgcaggctctgtggctgggtgaatggagtatgaacgttgaggttgtgggtgtggctgggagacattgaatttgaggtgtctggggagcataaagatgaacattttcacaagcaagtgagaactgtctaacatccaagaaaatgccacgggattaaaaataaagacttgaggagaatctgcagataagtctatttcactctgagggagtataagacagctggataggagagttttgagaaggaaaaggcagacgccaagaagtaaccttcgggaccatccatgtttcgggtgctgaggagcatggcaagtcagccagaacaattaatcagggttagtcatggaagaatgactaagaaggaatgaaatccctcagtcaagtgtcaaagaagtcagggaagtcttagaaagtgggagcctggagaggaagtcagggtcagtggtgccaaatgcttgcataggaagctctgccggcatcaagtacgattattatagaaagtgaggaattctctcaaatgccaccttccaacctgccagctgtcctgtgggaatgtgacacgtagtcctcagttctgatttaataagaatgacactaacagttagcaaacatagaaacgggaaaaacgctgccaacatcgtgtagcacatccctaaatacagcccatagggactgtctccacatgcttcagaatccagccccggagctccacgaataactgcatgtgagtccacgggcggcaccacacctcagagggagaaacacagccccccttacattctcaaggaggcgctgcttttgatcttttattttcctttgagttcttcactggcgcagaactttgttctatttgattgcaacatgtaaatattatcatcatgtcttcctttattagggacaatatttttttccctacaaaagacttgagctgaaagacataaaacactgtttcagtttcaggaattctagggaggattagaagaaagggttagaacacgattacccctgtggaaatctagggaaaagatcccatacctattttcttgtctttacccacccaactactcacaacccgtcacttatacacaaacaaatagtcactgtgcaacacatcttctatttctggtaacgtaccatggccaaagtcataaaagggtcaattattgaacctggtagagctggtggcaattttcaaacagaggcacaactcacatttaaagatgatacatggcaggtactcaataagtatttgttgaatgaaggtgtaaatggctgtttgatggctaagacatgtcttgtctaggtttgtgactccgttacagttggagggtgaattgctgtatttaaaacgggtagagaactgtcagagatattacctgctacgaagatcgtcagatctattagatatggatgatgtttcattgccagaaacagcttcacctaaaaattagcagccacagaagcagggcttctgtagattatgatgtctaacagatcaactccatatatgatacatggttgcaaatttgagcaacataataatatttttgggtgcctattaactgttttaacactgtgaaaaagcacagtgggagataaaggaagaaacaatggctgtgctatatgcatgcttatcactgcagaaacaaagaccgagacacagagttctcattctcattcccaatgggaagcagcactaaacacagagttctgcatgtggacgtgctatcagggcttagccagtggtacctggtcatttctgaactcatgaaatagatgatgcattaatatactgaaatttgtttttctaaagccctcaaggattgttacttatcctttaaccgtggctgcctaaaactggcttaattggtttcgattgatttaacaacccttcttcacttagtttatcgttatttaggaaaaggtcaaattatgtggtcattgttgccatggttcattttggaatagcaaagtcacacattttcacaagttttctcattgacaaattaaataaatgtccatttttagcaaggtttctcattgtgaggagcccctcctctcctctaggctccaaaccacatttaatcctcctgcagaccagctaccaaatgtttatttctcctgagcttttgcagctactcttggtccaccttgagttaaaattagaatttctctggatctatcaagaaatatctctcttctatgccccagtgtctgttcaaccaacagtctcctcttttactctaattcattttcctgtttgtttgtttgtttgtttgtttgcttttccctaggaagtatgagcattcccttgtttaatattttcctcatgttacattttacactttcccatgttctctcactgaactgcactttgcatttattcagttaaatgtagattgcttccagtacatactgtgacataacatgtttaataactgaaatccagaacagatattatctgcaccaatgtagtgtcacattcaattacaagctcccagttcttttcctttttacattattgatttctaaaccaataaaatggatacttattcaaagccagaaggatttcaagaaatatattgaaataactgtcagataatcttggtgaactttgtaacaaaatcaattatacaatgttcgtaccaagttgcaaaggcaaggcacgctgccgctgtgactacctgcctaatgcactcaatgccaaatgacttttctcccagacacaacatgaaaagcctgttactcaaaaggtgctagtctaccaactcaacttttgctttccaaatataatgcttttcattgctgtctagcaaaaaggagctaaagagtgagaaagatgagttaaaaatgcaaaccaaaggaaacttaaagacccaaaggttcaaaaatcagtaggcatactaaaataacattatttctcttctttgctatgtttctctagaagtagtgaaataagtgagtaccttataccataatttcacatcccaggaatcaatggccaagtatagccatagaaagagttgcggtgaaaaaactgaggaatcaaatgagaaaagaaacattgtaataaaatgtgcatcgttgagtcatagggaaaatctgccttcaaaacttttcctagaaattataaaaactgcccattactttgaataacacattgtaattttaaaatacttcactacataaaaaggcaaattaaaagaatcctttgattgttccatccctatggagccttatgaatcccataatccttgagaggtatctttactggcatacttataaatacacaattaaaatatacaatgaaaatccagtaggtattcatcccttcacttgcgggactccagctatggcagtatgagagctctgtactcctcacctcttcacactatttcttctgcatgatacaactcttctacttcagccctacttctcttgttaagaatgtttactcaactgagaggtcacatcctcagtgagacttcttattgccaaaaaactccactgggctcccttatgcttatttcctccagaactttctgctttccttccctcagctttactgcagtaactactgaatgtcttcagtgctagagtgtgggcctcctgagggcaagagccatgtctcttctgttcacaacagcattgccagtaccttactcaatgcctatcacataacagaaaatatgtagatgtcaaattagtaaatgaaagtgtgaagtggatggtaaaaagtcatcatagtaaatcactaaaggggttcctttacctgttttgcatatatttgtgtttttaaggggtcatacagcctgaagatacactatatatatttgactacagataatgcatcaaagcattggatttttatggtagaagaacaacatctagatcatagtatgtggcaaaaagtgagagagatgggaaagaggccaaacgtagacagcatctgtaagccatagcaccagccgactgtacaatctcacaccttactataggagagaaagcaagtccacattatcttttcagtagtgcatttatactacaagtatcctgataagaaaagttgtcttgggccctgttattttctgaatgtatgtatacctcccaaaatttatatatggaaacctaatccccaatgtgatagcattaagggtgggggcctttgggaagtgattaggtcacaagggcagagccctcatggatgggattagggcccttataaaagaggccccagagagctgcctcgcctcttccaccataagaggttgcataaagaaggtgcccatctatgagaaactcctcagaagacacctaatctgctggacaccttgatcttgaagttccagcctccagaactttgagaaagaattgctgctgtttctaagccacccaatttgtgacattcttttattagcagtctgaggtgactaacaagccctaattcacttaaatggtaaatgaatgctttaaaatgtacactcaaccaacattttgagaatcatctaaaggataacatcatatagggactgatcaaagggttttatgatcctaatgaatgtgaaaccacaggctacaaaaattctcaagagcaaaaattcctgatcagattttatcagaatttactgggtagctttatattaagtacttcatcatcattaatataccttaggtttcttaaatgagctttaattttatttacaatagataacattttgttggcatctacaaattctgggaaatattagagaaagtaacatgaatacagctttaattaaataaagattcaaatataaataagtgtttgcaactggtataaaatgtcatctttgtggaagcattttatcagcttaacattttgctgctactaacatagatgaggcagaactaatatggccagaagcaaggagaaacatgcatggaataagtgctgtaaatttttttctagagctatatattccttagtcagcatgcaaggaaaatggtaaacaaacaaggatgctaaataagaaaaacttggaacgttcctcaatgtaccaaacagagtgtgaatatgccacttcattagagggtggagcattctaattttataaaataaagttaaatatactaatttcattttcaaatatttaacactttactataaaatacttttcctgatgtgaggactgattcacagaactgcataaggttatttataatgttttataaatattatttgaaatgatatataatggcctacttcttaaattatagagtaaatatatacagtaagtccaaaactatttttacaacatctgagaaacaaattttcccctgtagagtgtttacactgaggaaaaaacagctagattatagaagttaaaaatatacgaaaataggaaataatatgtactaattaaagtaagaaaaaaatgagccttacagtctcagaggctttagaattgaggagtagagaatgaagcttgcttctcaattagctttggaaaaataataaagaacaaaacagctctccaacacaaggctccatcttattgtacagaccctaccaaacgaagaatgatctttctggcccccaaatacaggaatctaccactctgcagcctgtcctcacttctcttctgccccactgccccacaaacacctttcgaatgcccacaaatgcctctcacctcagaaatccttttttgtcttgatactgcttcttaaatagaaatatcttgttttagtcaaacccattcatttcatctatcacacaacagaaggtttctatttttagaggtcaaaaatctcagtgataacccaataaaatcaaacctcttcacgggtaacaactgtatacacacacacacacacggacacgtaattttgcatgcatttcaaggtttacagagcaggtccaggtctgatgttaaatcaatgtgcatcagaatggctcgaatgccagtaaaatatggccagggtccattttgattggctgtagtgtgcattcacattgggaggtgcccaggaacaaccagttgataaatatttagaatagcactctctctggggacatggatcccaacctagatagtagcagtaggaaatcaatgcactgctacatctatggtgactatccatcatacaggaagctatgtatgatacatactgaatgcaatttatattttgcagccaggaagagtctcacttctaggtttaccactcacttgctgtgtgatacaaggacatttatttcttcctaaacttaaattttcttatctgtaaaatggagataaataatatttttgtcacaggattagataaagaataatatgaaaagtatctagtgtctggtaaaaaatggatcctcaccaaatagatgatataatgacaaggacaacaatgctgaaatgtttatcatttagataatcttaacagctcaaccctcccttttgctctacgatgcccgagttcaaaatacttttcttaaaatttatatttcattcacaatcatttctatttcaaaatccttcctttccctgaaaatcacagcttcatggcattcattaatgatgaggcaattcccaccaccatgacagccttggtcatgaactacttgcagattcagcttaataatgactgactgagaatgcatcagatgctaggcattatatacacagaaattttaggagatcacatgatgacaccctctaaacaggagcctgaggaacagcagcttcaagtgagaaacttttcacagggcaaataacatctaaaataccaaccagaatacacagtaatgcaataatggccaaatgaattttagttgtataatgttctctcttttcacattgttttcatagcacacatttccaggtttctataaaaatcagccaatgatgaaaagcaacatttgttatcttagtttatattagtaactcgatttcccctaggactgctatagatgtggaaggggtttgggactgaattaatgaagctatttggataacagctgaaataagatccaggaatgaaataatgtatctataaatctttttctgtgtctttagattctgcaatcccttgagctactttcttggtacctggaggagaaaatgattattttaattttaaaaagccagtaggtgtaaatatatgctgagccttagaaacaagccttaaatttttccaaagatacttcatatatttcagatacaaaaatgtaagattttttgcactgccaatcttctaataaagacttaaagaaaagagaacatttaaaaatgtttattcatcatccatttcttcagcaaatgtaaaggtagagtctacaatctataggatcctatatggggtggggttggcaagtgcttcagtcatggtctgtgccttcaaggacatcacgggctgggcatggagtgtggacttgcacaccaacaccgccgacgtgtggtgatggttaactgatcacttacagataacatgccatgacagctcataggataaagcattacatagagctgggttttgttaccgaagaatgaggtttgagttgacccctgaagatgggaaggagtggacacagagaggagaaagaacatcatatgcagtgggaacaaacatttctgaaggtaacaaattctgctgagaagtgactgatgtgaaactttgggaagtagtcgtgaaaaggcagattggtgttggattgcagattcatactctgggtcatgacggctgggctctatttaagaaaccctcattgtttttacagtgcctgacatatgctacctgctgaataaaaatgtgaggaatgaaatggccagagcttcacctcgaccacggacaggccataccagaggcagcaaggcacacaatagaatactctgcattcagagtctcctcctaataattagcatgaccttgggtatatgcagtatcttgtctgagaaggaatatttcaatctacacgatggacataataactatcttatctaacggggtgtttgtgaggttcaaatgcaatcatcactgttgaaatgtactggaataataacgacgttgtaactagcacagaagagaccagtatgacatctattaattattccaataagaggtggtgaccacctgaagtggaaatggggaggcagggtctggtgtcaggggtaaaggacagttcaaagttgaaggcaacagggccaggactccagggcatctctatctctgaaatctactctgataagtgctgtggacaaaaatcaagcagagcggtgggatggcgggttataagagggtgggcagagaaaccatcttagaggagacggcttagagctgagatttaaaggaatgaacgccttccaggcagaaagaacagaatgtacaaaggtcctgatgcaggagctcagtaacgatactgagtgaacagtctagaagctcatttggccacagcaccgtggccattgtcggggcagcagaacatgtgcttggagagatggccacaatcacatcaggacagtcccatgggcacagtggacttagggttttactgtgaatgtgatgggcaggcagatggtttgtgtctgaaaaatgttagaaggatcactctggctgctgtgtgagaatcagctgagaacattctagacattgaagactgataggaataggactgggcaggaggctgctgcctggaggcaccatgagggatgatggtgtttgaacaagagaatagaagtgagggatctgtgaagtgatcggattcaaggtctagctggaggtagcgtcagcaacgctgctgatggattagatgggggcctgtataagaaagacaggagtcagataggacttgaagatatttgtccttagcaactgagagagcagtggtgctgtgctctggggtaatggtctcttcagggaagggcaggtttggcaggaagtatttagagttctatttgggacatgtaatatttgagatgctagttccccatcctactatccaatgggtagctgaatatacaaggatggagaaagggagagaaatagggctggaaatatcaattttgtagtcatccatgtataatatcacagaaagccatgggcacgaatgacaataatttaaaaggtataataatagagaagagttttaaaatgagatatgggtgctcagttcttgggttgctgggaagatgaggaagagtcgtcagggcagccaaagagaagtggcccatgtggccggtgtgcattcggcggactctgatgtcccagaagtcatgaaagaaaatgaccatgtcatttggggatgtgaggattcttggagtcgttttgaagagtggtaggaggaaatgacaggctagagtgggaggtgagcatggagagatgctgagcctagatattttttgaggcatttttagtagaaaaagaaagagagaatttgggtagtagatggtaagtgtgaagaaatatggaaggttatttacgaaataatgtaacttgggagatgctacaacaagattctgtctgatacgaatgaattacccagtatacgtcctcttattaaatatttacaaaactctatatggtaggtgttatcactattttagggatgagaaaatggatttgcaagggagacacatggtccaagacagcatgggaactggtggagctgagaaggaattccagctcaactgaacactacagtggaagcttgagtacatatacaatgtcaccaccagagtacatttacaatgtcaataaaatcattttttaactcacatctgggaagcaagatagcaccagactttgggttaaaggaaaaatctccaaatctcttattagttgaaaaaccttgctttcctttgttttgtttgtttatttggttgtttgcttgttttataagttactgatggaagagaacatcaaatattcgccagatacatgtgcagaacatttcagagctagggaggtggccaggagaagtttcagaagggagagtgaagtgaatgggcccagacacttcaaggacatggaatttatttaactagaatgtctgagtaggaataaatgaaggcagaagaaagttgaaaaattttggatgatctagttaaaggctttgaagcaaagagtgaggatttggacctgcttctctttagagtgaaagctactctgagatcaaagccataggtgaaaagaaaggttgacagcagcatggagaattgattggaaaaaggttttgatggaggcagagagtgccaaaaagaaagagtggatgtcagctcattcttctggtaagtaattacaataatgaccctatgctagcactgttgaaaactaaagattagagtccattattacaatagagctatttttacacgagaaaaaatcccaaggtttaatcgaaactgttcatactgaaactatgacaagccaattgttcctagtacttttaataagaaatatacatgttataacaaaacctatcactacaactgggaataacacagagcatcccaccttactgatggcatatcagtagcatcaccttttacataaagaaattctgtctaattcacaaaatatactatttttagggaataataaaatattagttttgttgttgttgtttggcttttacagactgggtcttcccctgtctcccaggctggagtgcagtggcctgatcatagctcactgtagtctctaacccctaggctcaagagatcttcctgtctcagcctcccaaagtgctgagattacaggtttgagccaccaggactagctaaaacaccgcgattaaaggcacagaaaacatttttacttttattcccgattagttgtcctaactgaaattttaaaagaagtcattgaatatggaatctgagaaattagaacaacagtaaattagatcctagctcttcagtgggttggaaggtgcatacttcattcacctattaagctgacatttatttatacctacagactgactgaggcaacagaaagagaaaaagtgctttttgataatacactgaggctcaaaattttaaatcagagttgaaatcatcacttcacaaagtctgctggagtgctgaggccatctgtctccttgccctgactcttgtctccacgtcagtgacagtgtgtgtagctgactgtggatctgcagatgagagggtctttgcaatgggctggtcagagaaggtagaaggtgaaaggtgaaaggtgaaaggctgaaggaatgggggaggggaggggccattttcagtctccttttctgacattactgatcatttctgatcacaaaagtaagggactccttgggattgcaaaccactttatttaaagaacaaaataaaagtcatattaggatgaactaagtaatatatttacattctacaaaagcgctcaaaatacagtctttattcaaaagcccaagtcagatggattttctcactgaagccttgctgagtccctcaactggagttcaccctcagccctgagtcccccagaatacattgtacatatattttaggaaagaaacatgttctactttctaaatttctgttaaaacataatgtatttatgtatatataaatatatataaataaatatatttttataaattgtagataatctacagaatttctataatatagaaattgtataggtataattttatatatattgtgtgttcatatatacatgcatatctcacacaggaacaggaaaaggaacatccaggaaaaacttcttcccctttagtaggattcacttaaggagaactcaacgatttgatgcatttcagctgtttgaatataacttagctactcagtaatacatatgcaagtattttaattctttttgaatcagcccaagtaagccttaggttctgaattctgccttgtgtaaatgtcacctcatttatttactaggtgcaaataatacactgctaagcgatatgtgttggcttccaagccatcagttatgggtttaaatttggaatctagaatttaccaggtatgtaatttggagtaagttaatttaatttcctaggcataagttgcctcatttcttaaaatggggtctatgcctccttggattgttgagaaaatgacatgggatgatatttggcaagtgttcattaaatggtagcctttgttttcagcatcatcactgtgatcagctgaattgctgattttcactttaactacaggaaacttgagtggaaaagtctgagtcatttatgtactcattacttcagcggatcaattccaagtaacaaagctagggcctctgcttattgtttattgtcagttgcctgaaagggaaatgtagaggaggccacttcatgtaacaacacagataactccaaaataaaggaattttatttatttatccacatttattaaaatatttactttgtaagtataaaaatatttaaaaataattaaatataattttatttatgaagtgggcagatgtataaagaggaatgtgtgaaaatgtatagaaaaaggatttatcttataagtacctcatttttaatgagactctaaaagaaacactcaatctattctaagaaaaatatagtaacatgactatcaaagaatcatttattaaaagccttcagcttcaagtgggttactttttaaaataaatgattttatttccaattaatttggaggtctggctgggaatataaaagaatattattgtgttgcacaggcttagaaatcaaacaagtctggactgaaatcatgacttgctatttaccagctactcaaactttcttggggtcagtgtccttatttataaaatggaggcaatattagtatatatttaagcaaatgtctgtagagattacaggaagcaggtgaggtacctaaaactacctgagacacctagttcttcactttaagggttatctgctttgctaatttctctcacactataagcagctagaaaaatagagaaacaactgttttctgactgtctcagtctgttttgtgctgctataacagaactcctgacactgggtaaattaggaacagaaatgtattggctcacagctctggggactgggaggtccagtatcaaggtgctggcatctggcaaggtctttgtgttgtgtcatgacatagtgaaatgcatcacatggcagaatggcaagagagagcaaagggggctgaacttgccctttcataatgggtccactcctgagataacaaacttactctaggacatgaatccactcatgagggcagagccccgatggcttatcgcctcttaaaggtcccatctcttcacactgttacaatggcaattaaatttcaacatgagttttggaagggacaaacattcaaaccatagtggatatatagaagttatatatataaaatacatatgattggactgaggtaatgcgggactgtgatcccgacgtgaaggaaacctacaaagatttggccttgttagctatagcagaggaagggagacaccaaacaaagcctagaagtctcggtgaactggggaaccacaaatcgaagtttagggaggttaaggaaactagaattttcaggacacaatacctaaaagaagtgacttgcacagagagagttctggaaatttgcggatagactaccttgaatctctggctgaatattatttttccgtacatgcatggggttaacaattctcaaagctcacacggaggtgggatattttgcattcccaccagacagagtggagagaccttatggtacttgaggcatctggtagagttgccagaagactactgtcatcatggtggggctaaattacccatagcattatggctcttctggatgccccagcaaagcataaaagcaagtctcaaaaggaattgatgtcgactagctcaactgttgcctgcataaagacaaactttttttaaacagaatgctacaaaatccaccacctaatgtacaatgtctggaatctagtaaatcactatgaatcgtgcaaagaaacataaaaataggaaccacaaccaggagaaaaatcaatcaattaaaaaagatccagaaatgacagagataatgaaattcatagtcaagaatatttagctactattacaaacatgctccatatgtccaaggaagtagagggaaagaggatcatgatgaggagaaaagtgagtgttgaaagtctcaaatgtaatatatggagagaaaaaaataccatattttcaataaagatacactagagagattaacaattgattagataatgcagaagggaaaaaggcagtgaatgtgaagaaatagcaagagaacccattcataactcatctcaccaagaaaatagggccagagtatcagtgacctatgaagcaataccaagtggtccaacacaggagaaattggtgctgcccatccaagcaaggaaataacaaggggagataaagcaaagcttgagaatttttagaagttggaaggtaactaagagaaagcaagagtgggggctaagaatgatggaagacatgatcgatgccttcagtccttccttgatacccagagatgggccattacctccttaaaaagaagtttaaagtaatgaaactcaatttgacacaatactgaaaaatggagttgtattcatgcatatattgtacattttgctgtcactattttaggggatggtggcagaaaccaaaggaggctcttaatgcctttggcatcaacaatggtgtttccttggcatctacactaacacgccttaattaacctatcaccatcttaagtccttgtagattaaaattgggtgaaaatttttagaataagtatctacaaaaatataaagccttcccttgaagagcggacaactgtggaaatatacaaagaatggaaaaatccactaacaagtgacgtgacacagaaagacgaatacaggcacagggaagagacaatttgaacagaggcttatgaggacgtcgggtgtgggaagggcccactgcagggtaaagagaatcagcatggcagtatgatggaaacacacccatagcactctccacagcatcacagtcatctccatgtatgggccatggtggtcagtttgcctaaaactagcactgggaatgacagcttgttctcagcttagctgtggactcacactgagagattaggtttcataaagcagaaacgtacatcagcctcagaggacatgagtaaaaagtataaaaacagacccgcacctatacataggaataaaatgaagtatctgtaggtaccagttgatctgaaatggcccactccaacgaacagaaggtgcctgcctgcaagcctactttgagttgttttaaacattatgaacctgacagagcgagactccatctcaaaaaaaaaaaaaaattatgaacctgccaggatactgaataaatgctacttagtacaaatgtccaaatataggaaagtccattatatttttggaaacttaatgtcaccaatgacttcatttattaaaaaggcactctgcatgtgagataaagttgggtatttgaatgattttaagtcactaaatagttctgtgaaaacagttcagcagaattagctattagaataaaagcattgtccttgataatatgattctgaacattcaattggggattgcattatgattcagttttcgcactctaaaatccaacttcccttttagtttcctgtttaaaattataatttctaagactaagagccacaattgcccttctagccttttgcttttcatgataatttagaaaaaaaagaaattgagaaacatatggcaggtaatcatttgcaaacacacgactctttcaatgcctgccatgttcaacttcattttatagcatctatcttggcaatataaattgtgtttggctgcagaggtatgcagtgcagtacaatgaagaaaagcaatcgtgacaactgaaaaataaacaacaaatgtgtgtttgtgagggagagaatgtgtgtgtgtatatgtgtgtgtggtttagacggcaccagctctctgcttttccggctttcttccaaaggggaatggtgttattttcgttggtttccttgttcccttttacagcaaagcaatgccactggaggaaagacaattgccacatctcagagggttgccaaatgacctcaaaccagttcaaaaggagcgccctcaccagttccacaaatgaaagcaatttaatgcaggtggattgggtcaggaatatttactattataaaggccatgttttttgaaacaagagcctacattatattaatttttaaaagtggtagcacaggaagactgtaagattatttatgatggccgggtgcagtggctcacgcctgtaatcccagctctttgggaggccgaggcgggcagatcacaacatcaggagatcgagaccatcctggctaacacggtgaaaccccgtctctactaaaaaacacacaaaaagtagccaggcgttgtggcgggcgcttatagtcccagctacttcggaggctgaggcaggagaatggcgtgaacccgggaggcggagcttgcagtgagccgagatcgcgccactgcactccagcctgggcgacagagtgagaccctgtcaccaaaataaataaataaataaataaaaataaaaataaaaaagattatttatgatatagtgactattcagaatgaaacatgctagcatactcacgtttttgtaaactttgactttcatgcaacttccccaaaattctctcaaaagtaagttttctgggtttttaataaaaattatcaaaagtatctaagattcaaaactttgaaagtatataactaagccttcaaaatcaaatcaaatttacctaatgctttatttttcaatgggttttgataaaccaagttaaatatatttggaatacttcaactgtgcaatctacagtttaatgtattcagagacattctagctcaaataagtgcagtcacttgtcttactgttcaattaacattcaaattaaccatttaaatttcaacatattttgctttattgattatgtattttaagacaacataaaaatgaaagaaaacatgcttgatttggaggcaatacatgcaaattacccatggcagtcaatattggtaatagagaaacttaaaaagcatccagttgatttcaaataaatgtagaatactgctatatagtatactttgcataagtggtatatactgttgggaagtagggggagcaaaagaagcttatgtacatggagttaacacacacgaagagcaggtataaagaaatagctgcccattgtcccatttgatggaagtagcctttttccctagagaagaagcattaaaggagagtcagtctaaccaggattatttgtgtgttatctgttctgaaaatagcgcactcaggcaagatgatcaccaaaacctttccataaatatagtctgcaatgcaccattgtaagctgtcccgtttactattttgactcatattaaatgccaagagtatgtaaacacatgatcacttatattaatatccatgcataagctgcttaaaagattttagttcacaaaactcagatacgaaactgcaataagtctgaaaagcagtaaggcaggagagaaggagagtagccaattaagaaatggatagaaaaaaaatgaaaatgcatagtgagaaggggtattatactggctaaatgtacaaccccaggtcatggggttacctgcaccagagaattccagatgctagccctggctcatgcagcacagatggcagcccagtggtgaagagcctgcatccggcagtcagacttcctggctccacatcctgtctctgccaggtacttgatgtatggctttggtcaagtaagttaaactctctctgcctcagtttcctcatttgaataatggagatgagcatcgttcctccattataggcttgttatggagactaaagcagttaatgatcataaaggtcttagaactgtggtgggaacatagtaagcgctatgtgtctcctagccgaatgaccatcctgaccccctggattttttatttatgcaataaagataacaacacagacctcaaaaggcacttataatcaaattatttgagttaatatttgtacagcattgcccacagtgaccaaaatagagtaaacaaacagtaaacagtaacagaatcagtattgctttagtgaagaaacagctaagatttaataaacacctaccatgctgagcactttacattattaattcattttatccgctaacaaccatgtttgaggtagattttatcatcatctctactacaaagatgggaaattggaaacaggtaaataataatgataaatactactagtctgaggaaagctactagaattgaataaaaaattacttataaaccaaggcaatcaacctaattaattagcctttggactttttctcagttaattcccaattttgtgactgaattggtcaagatgatttgcagtgttggcacgtaatacatggccaattgttctaggagatgttctttatttatttatacatgtgagaattactgaacaccttggcagaggccactagctagttgtcttggtgatacatatttttctccttcttccttgttgagtaatgagatatttaaggtggtaaaatggccacccacaacactagatttccaagtctcccttgcagctagaagtatcattgactaatttctggctaatgaaatgttggcagaaggttaaaattattccttaaatgcaaagaatgaagctggctggtacgagtctttatcagcaattctcctttcttcttcttgcttgcactatggacttgatggctgatgtgccatagaatgtcttggaccaagaggtgaccttgggaaaatagccatgcactataagggcaatgaggcagagatcctggttctcagtggtgatacatggcggctttagactacctatgaccagacttctactacagagaaaaatgtacacttctgtcagctttaaaatcactggaatttttggactttgttcctagcaggtgaatacaattcatgctgatatgagcagccatatgaactgaacatcaagggcaaacaagatacatttgaagaaaataagaatgcaaataattaaatgcaataaagcattgcacatattaggtaataaatagcacagggtataatgagattgcccaggagaaaagtgtttattctgtctgcatgggtttcttagaggtgatgaagcttgaattgagtcttgaaaaatgagaaggcatttgattcaagaagacaggagtgaagcgacgggctgcagccattccaggcacagagaactcatggggaaaaagtcacagagagatatgagtaattagatatttctgaatcaaactgttattagtcattagggtcaaaaatatataatttcatacagaacggatggcatatttgattgaataagacattataaaaattatctggctcatttaaagaaatctacatattcttctccatgtaatatgcttaaaagtggttgacacttaagaaggcaaagaaaggggctggtgatgcggcttgctatcacaggctctctctcaaaatgtaggtgctcactaccccagcttgaccctgttaccgcgcacacttggttgaggttaacaaagcgcacttggagagaactttaaaggcaacctttagaaaagcacaaatctccaataaattaatattctcccatcatgataaaaacacataaaatatgcaagatggattttaatattcatgactcacatctttcaaaagattggtgagatatcaaatgtgatacgataacaaaaaagcactttgtagaggtgctcaaagtactttcagcattaatgaattcttataatacccttgtaagaaagaatggaggcagagattattcaccataacttacagatgagatcgaggtggaaggatgctgtcagaagatcagctggtgtaggtttatggtgctccgagccttcctgggagctggcttccctacaatgtctgcagtaggtgcacacgaactgtaggacctatggtcacaggcccacccccaggtcaacctttggttgtagcttcaccactgcagagggggcataatgacagcttacatagttgatttcaggaacttttggtagttctaattgactgctgagaattgcaccaatttttagcttggcatgagcaaaaagcaaacagcttgcttgggttgctaaccctgactgtaaagcttcggcacagtggaaagtctcacactgacaggccttggtgagagaaccacatttgctccttatctagtaacatttaaggctacggtggagtgaaacgacgaggatgaacgtaaaaggcctagtacattaagggatgaggagcatagcaccaactcatcatttttagttcccagaacttaatcaaggattcaggctttcacacagaactcccattggtcatttctttttaatcactaattataagagagatcacagattaaatttccaaagaggaaaaatccctgatgacttcctgtagtcaaggtattcacttcaacgcaatttattacggaaattgaactcttctgatgatgatgggtaaaaataaccttcaatttcccttttaggtgtgtagacatacaagcaatccccacttttctcagctttgaattttgttgctctcagggtttagctgtttaataaagacctggatgtcaacagttcgtaccagtgttcaaacagataaagacaatacattcagaataaggatatgtagaataaaacacagggatttccccaaatggtgatttgggtggtctggggaaattgttcttttcctgtaagtaaggaccatctcattattttgtgctaagcataatgtcaggcccactgtgcctgggaatatttacacattggggggaattattgttgctagtggagagtcttgcctgcaagttgtccaggttcttggtattttgaacaaagaattagacaaatgcacagcaaagcaaggaacaaatgaagcaaagaaagcagagatttattgaaagcaaaagtacactccacagtgtgggagtgggtgaagcagcagctcaagggccccagataacagaatctttttgggtccaaatacccccagaggtttcccattggccacttggtggacatctcatgtaaatacagtgttggcccgcaatcagcatccaggtcagcttggctgcagaaagcaaccaatcaggctgaagtgaagttacaaaggtcatactcctaaacaaacatctgatgggcggcgaaaagcaaccaatcagaggctaaagttacaaagttgcacttctatgcaaatgaagacttggcctgtaatcagtctgactggttgcagacagcaccaatcagaggctgaagtgaagatacaaagtgacactactatgcaaacgtactttcaatttcccatctgccacacagaaaaggttggggtttgcaaagggagtagcctatggtccttttgttactcaggtgtggaatgttggggtttttgtttcaatttagttctaggaagtcagtgtgaaacggccttaggatccctgcctccagaccctattctcccaactgattatctctttttctatatagcacccacgtagccatccagcaaacatatgctaaagatagtagactagagatggacagtctggcccatgacgatgtcattgaacaatttagttatccaactccaaagcctctctacctctgaactcagtttataatcttttgcatttttgggggtaatatccaggtttgttcaagtgtgctgtaaattttatgttaacaaaacctaccttccctttggaaatcatgtaagaaaactaaaaataaatgtttagtaaatatatatatatatcgatagatagatagatatactaaacatatatatatacgtatgtatatatacacattatatatatataaattttttttttctgagaccgtcttgctcagtcacgcaagcaggaatgcagttgcaccatctcagctcactgcaagttccacctcccaggttcaagtgattctcccatctcagcctcccaagtagctgggactacaggcatgcaccatcatgcctggctaatttttgtgtttttagtagatacgaggtttcaccatgttggccaggttggtctcgaactcctgacctcaggtgatccgcccaccttggcctcccaaagtgctggggttacaggtgtgccaccacacctggcctacattctttttattcctcctgggctcaagtgattctcttgactcagcctcccgagtagctgagattacaggcatgggccaccacttctggctaatttctgtatttttagtagagacagggtttcacagtattggtcaggctggtttcaaactcctgacctcaggtgatccaccggcctcggcctcccaaagtgctgggattacaggcctgagctaccgtgcccggcctttttttattttgtctaaaaagatgcagggctgggtccggtagctcaggcctgtaatcccagcactttgggaggctgaggtgggaggatcacttgaggccaggagttcaagacaaggctggccaatatggtgaaacctcatctctactaaaaacacaaaaattacccactggcgtggtggcatatgcctgtagtcccaactactagggaggctaaggtgggagaatcatttgaacctgggaggtggaggctgcagtgagccaagattgtgccactgtattcaaccctgggtgacagaggaagactctgtctcagaaaaaaaaaaaaaaaaaaaaaaaagatacaggatcataccacgtctatgttggctacttccaatctctttctttagttgattttgtattgatgttgcaacctcaagggaacaaacacaggacattctcatgacatctgacacaggaaagggattagcaatgaatgtgacaatgtgaatatcatcttaaagcagatccagcctagtgagttcttctcagcattctggacaccctactaaatatgatttcatgataccttacagatttatattttttctttataaaatagaaagtaaactttttaagactgaatggacttttcattttaaggtgcagttagtatataaaggtaagggaagggtacttccaaacacaattttaaagtcatactcttaaaaacgatattagcaataaccaaagagatcatttgtgaacatctcgtatacagctatgataaattgacactcacagaggcattacagggttataattttaaccacaaaacattcaatcaaggtaattatattctacttgtccacagaaataacttatcaataaagaagtaatgtagacagtcatgaacagcataaaagagaattccaaggagacaaaaattacgcaatatttctatgcgaaaaaattacccagagatgtcctcagccccaagtcgacaaccagcatggaggaccctataatgacctgtctcagtcagctacatcagggcaccatagttctggtaacatcactgcttaacataatccagttgactagccttgtagattctgtgcctataaaacaaccattggataacaattgagctatccaaaaaaatttatctataagtagagaatgtgctgatgagtaaacattagtatcttctccctttgttagttttggttcttattctactttaaccaaccagtattccaccttttaaacagagttatctgatgagtttgaccctcgtgattcagctctgcaaaggctgatgacttctgaattcaccagcgtttgggtttccacgcctaagagcttgaaaaaaaaagactttagaacatggggaccattctgtcaccagtgagaaaactaaactatcaagattaagtcatggagattttgaggtccctgtcacagcagcataacttgtagcctaattcacatatactacctcattcaatccttaaaaggtcctatgcaggtagcacaaaaacaaaaaaatagtaaagtccaaggtgatataagccagattgaaacaaacaaacaaacaaacaaacagtgaccacatatttaaaatgtggaaaaaagcctaaaataaaggaataacatctaagcaaaggcctgaaagaaaaccataatatgaaatatatttttagtcttccctgcaaagagccaaagagctttgggcagtagaattctgagatgggccagcagtcaggaaattaggaagttctcagatacaagacaaaaagttcaaggatgggtagaaattgaaagggaaagaaaagttataataaagcctccttttatactttctgacaagacaaaaattgacattcttttttagacaattgcaggttcaagtgtgtttacaagtatggttgctcatatgtgtggccagggtgggggtacttacgggacaaacagattcttctcattcattcatacttaagatatggatttcttggcacaaatagggtagtgagaagtgaaatattactacaaccctgtgtctgcgtctgaccatttctgcggctgtcaccatctcccagtaggacaattcattgttactttgcaccttcaaggtcgtattagagaagaggcaatagccaggaaggctagctaggccttaaaatattgatttattttatttataaaataaaatataagactttactttcttttttcttcataatttttttaagacagggtctcactctgtcacccaggctggagtgcagtggcacaatctctgctcattgcaatctctgcctccctggttcaagtgattctcatgcctcgccctccctagtagctgggactacaggtgtgcactaccacacccagttaagttttgcatttttagtagagacagattgcactgtgttcgccaggctggtctcaaattcctgacctcaaatgatccgcctcttccagcctcccaaagtgcagggattataggcacgaaccaccatgcccagccaagactgtacatttttcaaagtaaaatcaagtcaagatggaaaccaggaaggttgccatcctgtactgttaagagcaaaatgaaggtcttgaggccaaaaagtgagtgcagacactctaagactccaaagtctccagggtctggtagtttcactatcaggggccagaaatgcagaaataacccgatccttgggctaggaatgcgcaactgtctagtgccatggtgagggactgcagccgtcagtgtcactaacgtggaagggcgaaggcagtcaagagacggaaagagggtcttcaggaaatgatactgatgaagcaagaacagggggccaggattctagaggtgcagcaggatccaagtttcctgataaataaacccccatgaatgaatgttttgtcttggaaagcactgtatggtataaagactctacattcctgcattttgtcacaggcctctaaatccccaacctagagcacctggacagatctcacttcttcacatgcagattcctgaattcagtaaaaaagccaataggaatttaatgacctcatttcgtagtaatattcccaataccaaacacatccactaccatcgccgtgtctttttaagaaaataaatatgtgagtaaatacagaaacagatggatattttaaaaatacctgacggacaacaacagtgaaaaggatcggtcacagcaataacttaagtgtgggctaatctgtaatggacatatgtatcctaagaagacagtggcaaaatgtttctgatgtgaatttaaagtgtctgagtttgggggccttctctgtttctgctcctgatttatatgctgtctccagagcatgagggtacaaatgatttcttgagggcagaatcttcctctgctcccgcacacaaggctttgttaccgcagggctgctctagagcacagagcccctggcaggattcgtctcaggtgaaaagaacatcaaagctgttactttgaaaaagacgcactccagaaaacgcagcacagtatggattttgcaacagatctcacaccggggaaaaataaatccagctcaattatatttgggtcctgcctttacaaaggctcattaacctctaaatcattcaaaagatgtaaaggaagagcaaaacgaactacagctttccctgccagcttttttcaaggtgaaatattcttggtgtttgggtacctggaaaggaagaaatgtttaaggaactctggttctctgatattgacacagacaggaaattggatgtatttatctattttaaggaaactgtccagtgttatttattctcccccaccaccccacatcctatgaggtgagtcaagcaattattgaacctcaattcatggtcgttgaatactatgaaaaaatgctcaaatgtcacctgagactgtgggctatataatacaattgagtttctaataaaagtaaaagagaaattggcaaagcataggaaagccactagtgaagatctatatgaggcaataaagacagcagggacgatcctaaattaagaagagaaaaaagggaagaaaatcagaggccgtccacaatactgaagaatgtaagaactgaagatgattcagcagatgacctgaaatttcctctgtcttgaattttcaagaaacagaatgtgctctccacactcgtaagtgggtcagagggtgttcccactgcatggatgggcaagctggctggccgagagtttgtctcaaggtttggctccatcagacaaacaggtgcaccagcatttccctccaccattcccaagggcaccttcttagaaaatgaaatttcatgctcagtcaaactttagaaacatatgatttaaacatatgccagtctctttctacatatttgcagcttcgcaattcttcacctcccagtccctttcttaaaatagcttgtggttgaagctaaaatgtttagttgaatagtcatcttttcctcttcttatctagcctatagaaatctctcatgaggaaactgagcagccacaagaaaactgagttagtgacgatttataatgtgatattttgatgcctgagactattttcagaattacaagaaaattttccttttccaaacacacagtcttccagaaaaaaatctaccatggaccataaccaatgaacactggctgattcacgtcttgccagtcccactttaagaaaaagaaagagagacagggtatgtgaaaaagttataaagataaaaatatcttcggaggacataaggtaataatcaatttttttattcacatagggtaagaaatcttttctataaggtgaaaagtgtaagagacataaactgcccagagttacaggataattaatttacactgattattttactaaaacacaaacatagaaagtgcttgtgaaaaacattatttagcaaaaaaaatcaaataattataatgctttatgtacccttaaattagcagcaatccattacaaacaacagattttatattaagggtcccacatgagcttctaataacaaaggtcactttttactaagacataacttgtggctgctcaacagtagaattggaaagaaaggctcttctctgattttaccttcccaaactgatgcatgccaatgaaataaaacgttatcctgccaaatgcaagcaaccctgggggagcttttcattgattaagtaaggtcttattgtgattggctcacatcgtttcctagtatttcacaatgtgtgtctcccaaattttccaaatccttcctaattttcatccaaagtcacctcaagcttctagaaccagtggaactactgttctccatgacacccttcctgaatagcctacctcaagctcaccaggcccactcagccacatcataacttccatctaactggcccgctatcatttctctataggtaagccctatctcctcaatcaaggtcattgaaattaagtgaaaatgattgaaatgaccaaggcatcaggaacagtagtttacagttcttccacatgcatactgcaggaacacaatataaatttcatgataacaagtgatcctcttgggaggaaggaagacttggtatctgccaggaatatgagtggtatcagccccagaagaataacaaggtgacggtgaggacacacaagaccaatttcccaatattgtcaaggagagtgtggtctacaaatgaatagaaagcagcattttaaaaatgatatagactcaactaggaaatatcagattgtatctcatagaaagagtaaattgtttgctgaaatctttgtttcagctacatatatgtgtgtgctggatcatgatgtgaaatctatttcttactctgggacaaggtcagagaggtttaaaatgcactgctttaatttgtctcaaaatgtgttccacaaaaaagcagttccaccaatgtgacctgcagaaaagggctccaaagtcgatgatgttcaaaaatagtagattaaaccaaattaaacagatattttaaatgcctgaattaccagggcttttaaaacgttaatatgatcacaagtgttcaaggctagaaaatagtattgatgcaggatattttcttgaccccttcacaggacctgtgacagagctgtcccgtttactcagcccaccatgctaaacccctcacaggagggagcgtgcaagtgagtgcaggaacaagcctgctccttcggcaccagcaggaacaaactccaattactcacttgggcctgctgtggcgcaccccttgcgggaaggaacgtgtagggaagtgagtgcaagaaatggtcagctgctttagccccagcaggagcaaatcatgtgtaggccctgtggcagcatccaggtggggctgactgtgacccaaaggcctcagagggcatgttacaatgctctcttaggtctgctgtcagcagacaacagtgtgttatcagttcagcgggccctttgcctcatggagtgcagtggcttccctctgccagtgagggcaaaggggcattataacagccttttggggtacccgcacttgttgggtcctgaattcttgtctggtacactggaagaataaggttacctagacaaatggaaggatgattaatgcggacaattttattgagtgatgaaagaggccctcagcagagggggagctggaaaggggatgggaggggaaggtcactgtcccccgaagtcaggttgtctctcttcctttctcctccgaggccaggttgcctctctatgacattcagcagtggctcagaagccaattcacctctccccaatgtccagccatttcccctctctaccagctgagcctggggtctttataggcacaggatgggggtgaggcgagccataagtagtttggaaagggcagcattcaattggtaaaaagacattattcagaaagaagtactcgggagagagcgggtaagcaggggtagaagctctcactttgggccatgggttcaggctttttggcttaaaggtggggctttgccagggacctgccttgtctgccaagagtttctctgcctcctgtctccatcagcataaagctcattctaactatatggccatgaaacctagggcaggtcgaggaactagcctctctcccaccacactctgaaaaacagtggtcaaagccagtgctgctgaagacacccgcatcgcctctgcatttcctgtctgatttcccctctgacatatgaccgccctgcacagcaaagcccattctagattacaggggagtgctcagtaagcaagaaaaacactgagaacatctgggagaaaaaaataataagaaaatgcctgaaaatttggtttcatgttataaggaatggaaaattcatttcaattcagtccccaaatctaatataggtttctcaggggaccatttgtgaagtagatgtgttacaataaaaaatgttagtagatcaagaaaatactgaatggcctacactctagtgacactagtacaaaaggagaaaaaaaaaaaaaaggaaaagaaatgagatgaagtgtgtttaaatggcacttgcccaggtctggttattatcctcagcatctgttagttctgctgaactgcatttgccttggtactagtcactaccattaaatttagacagtctaaaataattgttatatgaaatacaaggtagataatttgttatttaagcatcagaaagtaaaagagcatcaggtagtaaaaataatcaaaacaattcataatattttctttatgaactcatgtactctttcttaataggaagccatgatttttattttttatatgaatgaaaacttgatacacatatattttctttctttgatagatattctctctcaccagtataaaaggaaatagcttaattgaaaaatcaggttaccaaaatgaaggacattaattcaactctggatttcaggtgatgcaaaaaaaaaaacaaaaaaattcaaaaaaagcacaaaaaggactctgaagataatttatgtacttttcagcaaaacacccacaacatgacttctagactctatggtaaatcaaagatggaaaaaaaataaaacctaaaaaaaaaaacaacaaaatgacttactcagctgtttccattgaaaaattacttcccattaggagatgaacaaaatgcagcatttggttaatccctggcagtggcttaccattctcttaatactttcttctgcatctacacagttcttagtcagcacatatctgatattttgccatattgctattttaattacaaaaagctaatcaagtgaaaactaatttaaataatcaagtaagtcaagggcaaattaatcctgattcgtctaatacaagtttattacatcaaaatccctatctactctcatcagagaatttgggattgtagttgaattttctttttaagcagcactatgagactaccaggaatacagacagaactactactgaatttcaacatcagagacagcaagcagaatatcatagatacagacagaactaacactgaatttcagcgtcagagacagcaagcataatatcatagttttataaaagtgatctcagaacattcatagtaaagtccatcaagcggaaaagaacagaacagaatggtctcaaagaattaaaatgttgactattaatctcaatgcccagaaaaacttgccttcatccaattctaaggagccacttttgaagtccatcataaaagccacattctgtaaatcttgacactggctcagtgctcagaaactttcagttaagaaaaaaaaaaaaaagagtcaagggaaacacaaatttggctaaagaaggaactaaaaccaaaacgtgataagtgattataaaaccattttcaataagatgcatagaataaggtacaatgtctaaagaatgcaaaaggatggaggagcccagggcaacttgcttctttaaaaccatttgatttcttccaaacagacaaaattcagggaaggaatagtggaaatgaggaaaatgagtcataaatatatgccttcacccacatctcatgtttccttggttagactaaaatattttaatatttacatccctatgtactgtatatatatttttgctatgccatcataatcaaaacaactaacacagcaatattggataccaatgacagtcaaaggccactgaataggccactgaataatggaattgtatccaatcgtccaaaagtaacattacttgatgtgttagtcagggttccctgaagggacagaactaataggattgatgtatatatgaaggggagcttatcaggagaactgactcacacgatcacaaggtgaaatcccacaataggccatctgcaagctgaggagcaaggaagtcagtctgactcctaaaacctcaaaagtagggaagctgacagtgcagccttcagtctgtagctgaaggcccaagagcccctggcaaatcacagatgtaagagtccaaaagttgaagaacttggagtctgatgttcaagggcaggaagcatccagcacgggagaaagatggaggccggaagactcagccagcctgctctttcattttctgctgctgctttattatggccacattggcagctgattagattgtgcccacccagattgagggtgagtctacctctcctagtccactgacttaaaagttaatctcttttggcaaccccctcacagacacacccaggaacaatactttgcatccttcaatccagttaagtcgacactcaatattaaccatcacccttgattagcagacaatgttctccccctttgcacacaggtggaacagagatggacatcacccatttggggtttgtaaagactccagaccatgtggccctatctgggagcctgatttgtctaagcatccccttgacgttaggcactcaggtcatctcaagcatttccccattgcaaatcacattttatgaatacctgtatacatcaatctttccatttctagttatttcttcatggaagaagtggaataaagaactgagttaacaggaatatttttaatcctcttgatacattttaatctggttaattaaaaaaaaactactggcaagccacattttgccagtattttgtttttcctaatctcggattaccttcctactctttttagtctattctcttctcctctgcctcttccccaccacacccctgtaccctgtgctccagctccaagaacccttcctgcacagaaaagacaggatggcactttgcccttccatgctagctcctggctttgtttcattttcacatgtagtgccttcatgcccttctcctcttgctctctaactctcctgattacccccaccgagaatggctcacttcctcatcaaggttactaagtgttctgttcatgcctcatttgtagcaagcacaatttacattttctagaaatataaatttgccaaaaagctgctccagctgaaagatggtctctaaaagtactgacaaaaatgcaactggtactgcaagaccagagcttagaaaatgcttctgcacataaaaggcactctaaaggaaatgcaattaatacaggggaaattcaaaagacatcttaaatggcctcaattatactctttcaggataatttataatctgctaatgataaaatgcagatggcggactatattaatttcaaaatgctctaccgcagttttactagatatttctgggactataatgcaaaaccaacccaagacacattcagaaagacttctcattccctccaactacagccaagttgaattccttactcttgttaggcatgcatactgtggatctcaggttttaatgttctctgtattttatcaacagcttgtcttccataataataatactttcagtcctctggtctcaacattttgttgcaactttgttgaaacttcttaatttaatatctgaattcatattaaagccttctatgtttctttgagattatttttttgctgggagtctgctgttttcagccacctatcagaaggtaactcatgaaatagagtataattgtcagggtgcgataagtttttggcatattttctatgtaactgataggaaatataatacaaggctgttaaataatgaaaattttaaaaaggaataccattaggaaggttttctgtttgggtgatggatgtgatctatcatatagttctaaataataaattcagttttctgtctcaacggttgttctcttctttctcctcaggaaatgttacacgctgagcctctgtctcccagaacagtgctcctgaatattgaaaacatgctgcccagatctttctttcttctttgacaaaggctacttatcttgtagagtgtaaaagaccaaagctttttgtttgtttgtttgcgtttttttttttttttttcttttggtttgtttttgagatggaatcccactctgtcgcccaggctggagagcagcggcacaaacttggctcactgcaatctccgcctcccgggtttaagcaattctcctgcctcatcctccagagtagctgggactacacttgtgcaccagcacgcctggctaattttttatttttagtagagacggggtttcaccatgttggccagtctggtcttgaactcctggcctgaaatgatccgcccgccttggccttccaaagggctgggattacaggtgtaagccaccgcgtccagctgcttgttcctcttctgccttcttcctattcctttctttcctcctcccgccttcatccaacacggtttgtggtccatgttacttgggactattataggcttcaaacgagtctcgtatgagcagtctctagtccatattccacccctgtagctagtgcgcccatgttaaagctctatagtgttcacattactcccctgttcatgaatgctcattagccttccactaactaccatattaaatcccatctccaccttggcattcagggccatccacataacgctaaccctaagcctagtcagagcccatttacttgtgtttgtacctcctattgtcctcccacactcacccttagagcccctctggaccaggctctgtgtcaaaaacaccaggtgatttgcttacctttaggcctttgccttgcctatctctatctattaaattctgccgatcttcttatcgtaaatactgttttctattgactaattatctatgagaatcacacagatactcatacgtgagcattgcttttctaggatgcaacagaacttaatgtttcttatagacctggccatatttttcttttttagtaagcttttctatatattagcaacacacacttggcaatttaattttaaaaataacatttgcaatacaatcaaaatctgatctacttagggacaagacctatagactgaaaactagaaagcactgctgagagaaattttcagaaagtcctaaataaaatggtaagcatgtcttttacaagtatctgaaaattcaatattgttcagatctccccaaacagatctatagttttaatgtaatttaaatgaacatctcaaaaggcagatttctttgtagaaattgacaagaaagttctaaatttcataagggaataaaaaggacctaaactagccaatataactttgaaaaagaaaacaaagttggagaacttctgctacttttctttgagttttattataagttacagtcatcaagaaagtgtggtattagcatcaggacagaggaagagatcaatggaacaggacaaacagtgcagaaacagacaaatactaatctgctaatttttggcaaaatgtaagtgtaattcagtggagaatggacaatattttcaacaagtggctctggatcaattaaattgatctgatctatggcttgtaccttgtaacatttttcatagtcctaaatatgaaggtctagaaggaaaccaagaagatttttgtgaccttgaactaggcaaatatttcttgaatgtaacaccaaaagaatgatccacaaaagaaacattgtataaattggactttatcaaaatttaaaacttctgctctttgaaagacatgtttagggaatgcaaagacaagcatgcacagactaagagaacatatttgaaaattataaatctgatgaagaacttgcatctagactctataaatacttttcaaaactcaataataagaaattaagctacccaataaaaaacaggcaaaagattcaagcagactaaattttaacaaataaaatatatggatggcaaataacaacaatcactgatggtcaatagtattagtcattcagaaaatgcttattaaaattctagcaaagcaaattatagtgacataaaaccaagctgtgtttgcctacaaatgatgggactagaggagtgaaaggaagggatggctgaatggcagtcggagactttcctggttctggacatgttcattatgatagcagtgatagtttcacaggtatttacagatatcaaaatatataaaagcatatacacttatagcactgtgtcaaactatacctcagtaaagctataaaaataatcatgctagcaatgatctccatttttcaagttagtaaaataattttcagaaaaggaaacgtctgcatgtgtgagagagaaaaaaagaccacattagcctaaaaacaaacaaacaaacaaaaaccctgcctaaatcagatggctgtcctgggactcaaggaactgtgctttaagaggggactttctcctgtagtcccagctactcgggaggctgaggcaggagaatggcgtgaacccgggaggtggagcttgcagtgagcctagatcgcgccactgtactccagcctgggcaacacagagagactccgtctcaaaaaaaaaaaaaaaaaaaaaaaaaaagaaaaagaggggactttctatcaggcagagataataaaaagcactagtcaaaggaagaggcaccttatgcagaaatcactgtcataatccttcctgtctataggcaaggatggctctggaccaccaccaccccctgcattctaatttgagagtagatacactactccaacccttagggtctttcttgggttctaagaacactggatgagaaaatctagctaggatcaggcacatctatagcaaagctcacaggtttatccacaaaggccagccatgggctgaccacgtgagcattctagggatgcgatccccagaaatctaggtcacagacaatcctctggaaggtacaaagaggacactggagcaggagatgtggtgtccagcccagtaccccctaggaaggccatgtatgtcactaaaggatgctcacttaatacaggcagaatctcatcttctcagaggtatagcagccctcccttatctgcggttttactttccacagtttcagttacctgcagtaaattgcggactgaaaatataaaatgaaaaatttacagaaataagcaatacataagtttggaagtgtgcagcactctgagtagcatgatgaaatctcacgccaccttgctctgtcctgcctatgatgggaatcatctttgtccggcgtatccaccctgtttctgcagcctgccattgttcattgacattgtctgctcctgacattgaaacttgaacatgctcacggctggatgatccagaatcacctgacgcagataatcctccttctgacctaacactacgtcacaatgcctgggccgttcaccttgctcaatccaatcaggtaggcattttatcaacgcaacataacaagaagtgcaggtatggtaaaataagatactttgctagagagaccacattaacataacttttattatccaacatattgttataattattctattttatgattattgttgttaatctcttaccgtgcctaattcataaattaagctttgtcataggtatgcatgtataggaaaaaacagtacagtttgtgctctgtatccacagattcaaccaaaagaaacaaaatgataaaaaagtaataaaacaattgaaaactacaagttgaagaaccaacacagtataaaaactatttgcattttatttatttattcattttgagacagagtctcactctgtcgcccaagctggagtgcagtggtgcaatgttagctcacagcaacctccacctcccaggttcaagcaattctccctgcctcagcctcctgactagctgggattacaggcacatgccaccatacctggctaatttcaccgcacctgaccttacatagcatttaaattgtattaggtaatccagagatgatgtaaaatatacggaaggatatgcgtaggttatgtaaaaatactgtaccaatttacatcaggaacttgagcatcagcagattttggtatcggtgaggagtcctggaaccagccacccgacagacactgaggcacgactgtttgtattgggtttggtactgcccaaagtttcaggcatccactggggatcttggaacctatctcccattgacaagagggaactactgtaaccaagaaactttgattaacaagagaaaactgtatggaaaaattcactaattaaatgataaacataatttacaatataataccttcataagacttttctaactcatatgcaaatagtaaaaatacacaaaacaagcaagaatgcaaaaaattttccctaaatcttaccaatttgcattaaagaaaaatttctggccgggtgcggtggctcatgcctgtaatcccagcactttgggaggccgaggcaggcggatcacaaggtaaggagttcgagaccagcctggccaatatggtgaaaccccatctctactaaaaatacaaaaatcagtggggcgtgatggtgggcacctgtagtcccagctactcgggaggctgaggcagaagaatcacttgaacccgggaggcagaggttgcagtgagccgagatcgtgccactgtactccagcctgggcgacagagcgagattctgtctcaaaaaaataaataaataaaaagaaaaatttctcataggactacagttcccctgggatattactattcatttataatctatcattttgcaagctgaataccttcttaacaatttcttaaagtgctatgaatgcctagacttctaagacagtgatgccagtgtctctaacttcctgtatatgccacgctagtttctgtatagaataggttatcaattttacgtctgtgttaaggacaggaatcacaggacatctcacttattaaacggcatctatggaattatgccaaacacatttatctataaagaatgctggtcctcactatttttcattaatcaaatgcaatgtgtaaccagttacaaagcctgtagtattaatagaagcttctaatctgtatagcatgctgctttcttttagctgaaataacatttaaaattcataaatattggaggtaaaaagaagaaaaaagattataatgtgtgctctggcttgtagcccgaggagaacagaaacaggggaaaaacaggtaatgctttccagcgatgagtgatgaaaaagaagcacaacaattccagtgactgtatgagaacagccagaaatcattcttctaaaaaatagttttaagcagaacaatgatctagaaaaggatcacaacacattgcaccgccctgagcagtcccataaagcagtgtgatgcctctataaagcaaagttccgtccaacagggctgtcagaggggaacatgagtgaaagggagggagcgccttgcacatttatatccatgctgcaatgatccccacatctctcatggtgcccagcgcacgtctcctcctgcacccacaaccaggaattaggctccacgttcacctgctctgcagctacaggccttatcctctaattaaaccaaccccactgctctagaagaatagccctgctcggtgactcactaacatttaagaatacacacatgtgaaactaagatgaaaatgagggcggagatgatttatgtgaaaggacatttaaagatgaataggttttgtgaggttgaggaagcctgcccctctagagacagaggaggcatttgctcaagtgtggaataccagctgttgaaatgttaagtcaaatgaagtagaaatgtaatgttatttaacaatggccgaaaaggaactcgctaattagtatttagcaaaaaaaggttttgagtggtcaacctgtgtatttgtttatttgtttgcttttgtttggagacggtcttgctctgtcctctggagggcagtggcactatctcggctctgcaacccccatctccatctcctgcctcagcctcctgagtagctgggactacaggtctgcgctaccatgcccggctaatttttttgtattttagtagtgacggtgtgtttcaccatgttgcccaggttggtctcgaactgccgacctcaggcaaacctcccaccttggcctcccaaagtgctaagattacaggtgtgagccaccatgcctggcctaatctgtggactttttgtgtgtagagtgtgactgttacaaatgggaatgccctaatctatatgttactgtggaattttcctatataacaaaagaaacttctaagaactgctaccatttggaatccagtaattgtatttatattgaaatatttattataatgaagtatagcagaaaggctagtgagttacagaacaatatcagaagcctatgtgccatctaaaattttcttttattttttaaattaaaatgatctcaccaagcttaatcatctctaaatctaaaattttctaccaagtttactaggacactagaggcctatttctccagaaaaaatggtaatactaatttttacatatattagaaactaaacattttccaggaatgtacaattactctggaaattccaaatctttatgtcaaaaaacctagaaaatctgccaaatgtaccatgtctaaacctaagtgggtattgctactaatggtatctttactctgtctttatatagaaacaggcttatttggaatttagggctcagaaatagacctacacatacatgacatggtcatttgattttcaacaaatgtatcatagtcatccaaataaaaaagtaacaactgcatatccatatagatatccatacctcacactatcataaaatttacatatgttggatcctaaacctaaatgtgaatgccaaaactatggagcttctggaaaaaaaaataggagaatatttcatgagttgggattaggcaaaggtttctttgacaggttagagaccacaatatcattaaaaagtaataaacttagaaattaaaacatctgttcataaaaaatatgaagaaaatgaattaccaaactccagactataagaaaatagttccaaaacatacacctgataaagtactgatatgtaataaatagatcaaagcttccagaacaatatatacatttcctaatgaacctaatttgaaagtgaacaaaatacaagaagagacatcacgaaaagaaaaatatgaatcactaaccagcacgtaagaaagcacataacattgtcagtgagtctgaatggaatgccagtgcacaggcaccagaatgaaagcctgacagcatccgaggcggcggagccaccgtaatgctcatgaagagtcagaggtttgaccttttgctatcaatgttgttataaatgttaatgcacaactatctgtcagcccagcaattccactgcaggacatttactcaagagaagtgaggccgagtgtggtggctcatgcctgtaatctcagcactttgggaggccgaggcaggcggatccccttaggtcaggggttcaagaccagcctggccaacatggtgaaaccccttctctactaaaatacaaaaattagccgggtgtggtggtgggcacctgtagtctcagctactcaggaggctgaaacaggagaactgcttgaacccaggtggcaagggttgcagtgagccagggtcatgccactgcactccagcctgggcaacagagcgagactctatctcaaaaaaaaaaaaaaaaaaaaaaaagagaaataaaagcatctgtttaaaagtggtttacacaacaaatgtttaccttgttgtataaatgctctattcaagagagtcaaaacctggagacggcccaggtgtccctctacagtagacaaaaatacttctcagccataaaaggcatgaacggttgctccacacaacagcatggaaaaatcgccaacatattttgctgaatggaagaagccttacaccagagtagagaccacatgactctttatatgaccctttagaaggcagaaattgtggtggaaaaaaaatcagaagtgtttctgcccctgctgggtggagggcttggaactgaccaggaaggagcatgacatcattctctggggggtgataatgctctgcagcctgacaggggctgaggctgtaccactatatctttgccacaactcataacattccaccggatataaaatctatctgaaaaactgaactatgaacatgtattgaacttgtttgtcatggtgttcatgttgaagtatttcgaggtgaagtatactcatgtctccaactcactttaaaactcattttaaaattcttcaaaaatgagacgaattggtaagtggatggagaaggatagatagatatttagccaacaaaggaaatagagtaaaaagttaattgcagagctctatcaaaaagcaatccttacccaacagcatgaagagattagtagacagatgctctagcttcccattctctggaagcacaattctatgagacattctccatagctcctcagatgcccaatgagactgtgccctaattgtcccctgcactataaactcaactacccactctttgtcagctttgctttattttccatctgactttcccaactcctcaatgtacttcccaagattactcccaaatgaaccacctgcacctaaaacagagtctttggttctgcttttacaggaacccaacaaagatgataatatagggaatagcatgcatatgtccaactgtgtcagaaatgaggagccaagctgatgagtggatctacagtgatgttctaggaaatttaaaatgtagaattccattttcgcattgtcaaatgcaaggtgtacaattttgagaattttaaataattgaatatataaaatgaaggctctgaaatatctgttgcgatagaggtaagagatctgacagcttgtatgttggcatcacaaaactattgtcagttgttacataaatggatggtaaagctggaatgcctggattggagtctcggccctgacgtgtgcttgttaatccctcctgcctgggtttccttgatctcttaagcaaaatgttgaaagagcagctggatcatggtaaatgctattgaagtgtgctattgtttttattattgcctggcaaacactaaggaagtctatccaaggaattgtaacagaaggaaaatgagggatctgactattatagagaaaagtaattaatttccacgaaacagtcagtaacttggctaaagcgagctttggattatttgtcaattctgaaataacagggatttttttttttttttcaaaacaagtaaatttaggacaaataagatgacgtacttcacaaagtaatgaaaaatgtatgggagccattgttcctcagggatgggaaaaatttgaccagtgtttgtgcaaatttggggaaaaaaagtcatggactagcactaaaggaatgagatctacctagactttgaggtttgtaaagggtcttaatgaggcaaacaccaactgtgttctttcttgattctgttcattacctcatttaattttcaatggtcttgccgtgaatatttgcatgagatatagaatatttttaaagcaagaatattaataacagtttttcattttaggctcattaaataaaaacgtcattttttcactaattcacatgacatttattgagatgtattaaaaaataaaagaaagactttgaagacaaaattgctcaaaggttaggggcaatctgctcttcttggagtaaaattcaagggccattataagaagtataagtcaaattatagtaccaatcaaagaataaaatatttttgatggaactgatataaaaaagttgcgtatccttgtaagacgaatttctttctctccctatctctgagtagctgcataaaccactaagtttttctagaagcaagtgataatgctttatcataggtacaggcttaaagaatgattaggtacacttaaagttgggtactcctatcaaaatccaagacagtgcattgcttctttcctttccaaattttttttttcagtcttgtggcccctaactagtaattaagagaactaaattaaagttcatactggctacttgaaatcttacttttaatattctttgcattatgcatggaacttgtctatggttttaaaatccaaggggaattatgacatttgtaaggcaaacccaggctttcatccatcattctaatctgttttacaaaaaaaaaaaaaaaaaaaaaaaaaatcaaagcagcatttgggggacaaaatgagtgacagaaaaatggcaaaaatgtgtcaacaatagtgagatttcagagatccaggagactagctactaacctcagcatctcccgagatactccattatcgctatttatgttattacagatgatataaatcttacgtacaatcattgtacactgaaaagtagcagaaggaacagaggtttgtgaccagaatctatgacgcagggaaaattaaaaatgcatgaaccattccatataggagggaattgaaaattatatgcaaaagagtatatgtacacccacagacatgctatataaaaatgaacaaaatttaaaagcttattgttacccattgttctgatacgtatttctgttttcttggaaggttctttgctggccggccagattcctaaattttatatcctgctgcactagtgagatatgtaagaggattccaaacactcaagtgtccaaactgagctgtgctgaagacttcaggctctccttcccgtaagatgagaggtcatcaggaagatgatgctctgtgataacaggattgaggcagaaaagctatttgtcacattcccttgtttggattttggttttggactagaaagaacactggcttcaaagtcagaaatcaagaaccaaagcccagttctaacgtgttttattagctgagggacttcaggtaaatcatttagcatttctttccttcagtttcttcagatatttaatgaaagaattagaccaattgatttcaaggttctcattttgtttcaagattctacagttataaatcataaataaatcaccagtaagtttgcgtttgtcaaacaattcaagttactaccactttacaagggcacatattaattttcttaaaaatttatcacatgttatgtaaaaaaataagacttctgaaatacttagacaaaccataaatgtgcaaatattctatttcactacctcatagacaagttttagctgattagcatgccctgatgaaaatacacacgatatgcaggtgtaggagttggatgaatatttttaattgtgtatctcctctgtaggccaaaactgttcatctactaatacattagccttaaggcatgtgccacttttagtgactcagttgttaaaactgcgttacagctgcatttgctcccaaaaaatattaaagtcctgtaagatttctattaatgaatccttttgatcttctattttacatcaggtaaaaggtttcaggagcttctccattgttacaacatctccttgtatctaggaggatatgggggaaaatagcaataaaataggtggggatgacattctgatactagagagcagttaaacgtgatgggggaagaaagcgacgatccaacagaatatcctcgagtaggaaaatgattttatcgcatgactgcctacctcattacaaagtgaaattcaccactatacattttcgtgtgagctttcatctgctgtacaggagagtggctccctgggtttcctataacagctgttcccatgaatctaccagatattttgtttccacttttacctttcttactctctgtctccatacccttctgagggatgagggtctgttgcctaactctttcattagttatttatttatatctgctctgggaaagaagattgtggaaaatgtgagagcaattcacacatcaacgttttaagatcccgtgtacaaatgggattgctccggaaaagcttcttcccacaggcactaattaaaaagcaggaagttcacttgagcagcatttttcttccgtttattttcctttgtaatagacatgctactttttactttaatttgaacattatccctctctgtccaaaaaaatacaaaaacaaaaaccaaacaaaatacagtaaaggaaggcagagtataacattaacaatttagaaaagatattattttcccctaataaattctactgcattcttggaaagcattaaaagtataacaggtcacacatccttgaaatattagatgaaggaatttgtgaagacagactattggaacctctgagaaattagctgggcctctacttccgtggtcattctgaagcatttttagatgctggtcacgattaatgctggaaacaacgttagtgacagttcttctgtgcttatcacatgcctttagttcaggaccgaaagaaggaaggaaggaccacaaatggtacacgaatgggctgcacagggtggtttaaaaggtaagaaaccaaagtgattgcttgtgtctcatttaagttaaatttaccacaaagttcatattcaataaatttaataagaaaggtaaataaaaacaatcacagtaagaattacatatgaaaataactatccattcattctattaacaaactaataaattattgaacatacactatgagtgattctgtcctagatactggagattttcatgatatactaagtatgtttcctgcaagagttgaggatgtcagaaccactgggatactgcggttgaatagacaccattgcctcttggtggtctgaggctggtaaatacacaggcaggaactacgcattgcaacagaaatacctccaaaggtccttatgaggatggtgcacacagaaaaaaacgtagggtcatggagaaactggaaggaggaggatagaagaaataggtgaaacaggctaagatttatccaccccaagttgggagatggtattccagtgggaaaaatttcactgctaaaactaaactagactagcaattctgtaagatgtaagagtgtgagtgatgagctgagggacagcctgagtggttgaaacgctgcttttctgatgatttggctgatggagtggccctaagcaagtttcttcaccgctccgtttcagattcctcctctgtcaaaccgggaaaatactcgtatctacagtaagagttgaaggattcaatgaaggatttaatatatgcaatgctgagaaaggtctgtggtgttcagtaaaaaatcagggtcttttagtttctttcgtagggctgcacacgcctgacacaggggatgtgaaacacagacctctcatcctacaagtcccagctgcacctgaccccagcagcctaactgcccctggcccatgactctaccccagcccattatcttcttcataatcacaatttataacttggctattgctacattacatggtgcatttgcctatgtgtatacttgcttattttgcatttattttcctcatatatgagccctaggaggatacggacttgcctgtatttggggactggaacatataaggtgttcaatgagttttgttaaatcattactgatgatgctgatgatagcctgccactacatagctcttcctttgtgctactcttctaagcattttaaatacactaatattcttaattctcacagcaactccaagaggcctgcctcattaagtgggtcctgttactgttttatagctgaggatattgaagtgcacaggataaaaaagaaaaccacctaaggacacagagtaagtgatagaactgagtgctgagctagcagtaggctctcaaaacatattcttagccattaagctgcctggttctaagtaactaaatgacagatcggagcggggtgctgcctggggccctggctagccagtaggcagaaatggaccccaagctacccagggatgggagatggggcagatattaagagaaatgaggcacatcctgtactagacaattttcctagaagcccagtggctgagctgtttcatctgcagccaagagtgatgttccattgtttcgcatgcactctgtgagccgcctgctgcctgttgcctgagccttactccttcatccagcagagccaggccggcccacaccccacactcttaccacagatggactgggtttgaatcatggctgttaaatgcccttcaacactagtcaagtgattactttctttatttcttcacctgcaaaatggggattataaggtacctacctcataggtttgtggtgagaactaaatgagttaatacagagaccaatgcctgggacaaatgtagctcctctaattaacaatttgaattccctggtcccttggtttagtccctgtttgtcatgtactttacaaaagtgacaggttcctattcttggaaatgaatctgtctatactcagaatcagaaaaaccaaaggaacaaaataaaaatggaggcataccagccaatgggtgcctcggtggtatctccatgaaatctaacccatcagaggcagataagcacagagtccaaggccttcctctccagaagaaagaggaagaaggggggcgtgtgggagtgtagagtgcaaccccctgaggggctgaacccacagaaacagcctaggggtgagataaggggtcctggcccctgaagacaccctggggaattgaatggcttggggatggggaaggagaaactggggggcagaggtgaatacctccccatttctcaatgcctggcacctgccattctgctgttcctttctttccaagatcaaaacaggacattggccatcctcctgggttgtgcttccaaggctctctttgatcactctcagccctccagcttccagctgaaactgacctctagtggcctgtacactggtcttactacagtcattgcccccagattcagaactcccgtctcatgtcctgattgctgtgcagtcagcatctccacggaccagcactctagattatagcaccgagtacaagatggaaaaccaaggaatttcaccaccagttagtgttagacaattcattgttctttagtggcttgagatttaaagtggcaactccataaaaactgacgaagccttccttggtgttgacctttgacacttgtgagcagccacatgtggagtgcgtcctggacattttcaggtatctattttgatgcagcttttttttttttttttaaattaaacagactttctcactaaattgctttgtcatggcctcagggagaatctggcctacaacactgtttactatttcaagtcatgtgtgaatttgatgccctcatttcctcttcttcatgcttgtcttacaccaatcaataaaggaaggaactgggtcatagtctcctggggatgactcccagagttcaaattctggctctgcctagctgtgtctttggaccagttagtttcttcatctctataatggaattgcaatattactttatagggttattgtgaggaataaataagataatgggtataaagtgcttggctggagcaaatgttcattgggtgtcagctattctcatcgtcacgatcagtctatgagatggagtccactgtacttggtacttggaaataagacgtgtttatagatctgtgctgacatgtcagttttcaagagccaccatatatcctgctctatgcgtaatctttgtaatttagagtaaatgttaaggaagagagggcaggaaggaataaaatgtaatgagcaatcattggacaaataaattgcatccactttttaagtgcattttgtatacagtttaaaggtagaattcctgaagttatacgattttaaaatacacttgagaaaggtgatgggctgtccaaagcaatgattttcttctaagaaatacttacacatatagaaaatttgtatctttatatttgctgatgtgaggctgctctacactttgttcccttccatcagcacgcaggaaataaataaaatttgcccacacgctaaataaaagtcagctgaatcccaagtccttgccgtcccctcaaccacacaaactcatgcacccataaatatcttctttttggttctgagtgcacacagaaccaaaggaatttgtattgaaacgtttgatttcacttaacctgcatatttctatttctatatatcttaactctgaagttaaaatacaattcttccaatgatatgaaacacagtattttaaaggtatcacacatcttgggttgttagcaagaatttatataatcatttatccaaatcactatctattttggcttcacaccagacttctaatcaattctatatccttgttcaaggcatgtttcttatttttcaccactagtcaggtattcattcccttgtgctttgttcttgttcatttaacacacaactagtcccattcataggaaacacatcctaatccaattggtgttttacaaattgaatcttcccaacagaaagtcattgtgtccctcctagttcagaaatactaactgcatgcacttgaagttaaatcaaaggataattactggtctaatattttggatcatcttaaatatagaaccatattgtgctacagctggagaaattctgagagtttttagataacttggaaattacacagcctaccgaggtgtctttccccaccctgtgaggctctactaaagagacaagggggacttcacagaaagtttaattcaaacttaattacacttgagcctgaaagttgattaatcggttacatttgcaagcagcagaaaccaactctggctgtcttatacatcttgtacaccttgttgtcttatacaccttggtaggatgttagcctccaagtctccctccaggcaagctgtcccagaggtcatagagcaggaagacttggaccaaattaaaatgcttgaatcacgtaactttttaaaacatagtttgagaaacaaaagggaacagaaaagaaaagtgagccaggggagaaggtgatttttgtttattgccttttatatctattatattcccagcaccacctacaacactggtccggtacatagcaggtactttatgaagatgtcctgaatagctataggatataagtatgcaacccttttgtaattattataagacaatgtcttggaaatcatagctaaaaacaaatcaaacgaaagaaacttagtctcatattctattgtcaaaaattcttccatgatggtatatgcaatagaagctgtactggtggatttctcccatgtacaggttagcacacaggtaacatatgacctacagagctgcagaggatctgtctgcttagtgctgaaggccaccacttgatatagaaagtagaagtggggtgtcagggtggtagggccactggtccacgggacatactgctggaatagcaagacttggacccctgcttctgtttatcctaaggaagtgactggtgctcctctgatgatgcaatgcaaatgtcctgcagtctaagggctgttgtctgacatccagtctcagtaaatatctgtgctgccccatctccatgaattctccatataaaggctatttgagaagccaggctgtgagtgctctccaccatgtagccttcactgacagaaaatctgctcaatgttttaattttaaaggtagattatggattcttttataattagttgtagaaaagatcctctggcaatatggtagttagaacacatctttgccacccttcgctctcaattaaatattcaactcttacctgctaagcagggggagcttggggcacatgactaagccttaaagtcctataaaagtatcagcagaggggcctattaagatttggagaggggtggaattagatgaataatctaataaagaataaacatccctgaagagccaagaaaattatgtagaatttaagttggttgaggctaggctagtgttttaagttggttgaggctaatttaatttaagttggttgaggctaggctagtgaaagaactgtgcagtcactagactcaaataagtataaagagccacaccgtctcgtggataataccaaataatagaggacccataagtaaatctaggactatatggtacttcattttggccaggtgatatattgatatgttgggagaaaggattatttaataaatggtaatgtcacagaaggccatctattcaaagaaatgaatttgggccccttcatcacaccacatatgaaaggaaatttcaggccaattaaaagttttaaatgtagtaaactaaaaaaatagcagatacatctgacatctagaggctcggagaccttgataatcgacaggtgactacatgaaaatatttgtatatgatgataccataaataaaaaacagcagacagtggaaactgatagactagaacaatatacatgcgactcccacagtagagaaaaggttactatctgccataaatacggcttacactgtgatttgaaaaccctacctaatgtatgggagcagagagaaatgctcaataaacagatgaaacaaaatttaagttacaagaatattttgttttggctaatcagactctgaacacaatgaaattccttttttttttttttgggaaaaggagtcctttcataaaatgaaagcaaaagtgtgaattattacagcctgaaattaaggaaataagtataaggacatatattttactcacacacaaaaaaataaataaatgcatataaatatgtatacccctattcactggattgctgtatatagtcacacacacacatgcacaggcactcacaccaaaatctagaaatatcagtaacaaatcaataggcaaatgtttaaatcaaagccattgcagcagagcatagaatattatgcagtcataaaaaatttttaaaaatagaactataaaaattacctttgagagaatggctataaatgattaagagaaacaaattcagaagaaaaaagaaaaaacttatttctatgtgtgagtgtgaatgcatgccagagatatcagaaaggattttcactaaaatggttagcaatgcttgtatcagcggtttctacctcaccttttttatattggttaagtgttatataatgagagtgcattgcattatttgtcacataaaatttaatttgaaagctatttcattgctaaaaggcactggtataactataacttatttttctcatttaaaaatattctatcaaaataacatagtgcttccaccaggtgtgtgtcaaaaaaagaaaaacaacaattactaatgcctatcatttaaaaggactttgatataattaagcgaaaaaaaaaataaaagcaaagcacgttctctttgtgccttccaactacaccaagaatacaacaaagacggcagaagtttgtctgtacatttaataaagaaaacaaattaaagagagtgctttgcactgggacatttgaatccagtggcagctgccagattaaaaaaataaataaagagccatagatcaagctgcagctgcgtgcctccaactcactccgcagcacaggcccaaagccattgtcagtgcccccggatgtgtgggtgtccttcatttctctttgaatgtggccaggcctcttgaaggagaacactaggtggcatgcctaccaagctctgaaacaccattaaccaccaggaaaaaatgcgattaggattctatttggagatcatattttcccctgtaggctaaggaggcattctctaacactgacaggctctgagtctctttagccagaaaatcaaaaagtttctgtgaagccactaggtaggacttttagaaatagagtcgctacatcctctaggctcctgggaaagaacctgtagctgaattatttttgtgggtcatccgtaaaatgttaattgtggattgtcaaacccttactgcagagaggactttcacagaaacagttctatttctgataaatcaattttagcagaagagtctcttttgacatgcttaattcaatgagcaaattgtaatgggcctatcccttaagacactggtgtttgtgtgtttgggagtgttcgctcagcaatcttggccctgatgctgggggaatttgaacctgacaggcccagaggatggggccagcccctttccctggcctatggctccggtgctccagacacacacacctgagctacctcccttaaaggttggaggtcaattaaatccctcaagtacctactaccaagctatttgtttaaagactattttggccatttttttgatcagtaggatattgtcacgtgctgccaaagtgctgcaggtggacatgtttgtgtgttctgaaggacttacatcatcctgcaatggtcagctttatgacacaaagaatgagtgataactcagtcttctcagttttgtgtcgtttgtggttttgtttgtgtttatttctttccctatctggggtaaaagcctcagtccctgattcagcagctttctatctaggtgtctgatttactgaattgcatcatctcttcctcatcagtgttttcgcttgtttgcttgtttgttttgagtcaagggctctccgtctgtcactgaggctgagtgcaagtggtgcgatcacagctcgcagcagcctcaaactcctggcctcgagcgatcctcccacctttgcctcttgggtagcagggactacaggtgtgtgccaccacacctgatgcctggctaatttttaaaatttttttcgtagagacggagtctcactatttcccaggctggtctcaaacttctggcttcaagcaacgctcctgcctcggcctctcgaagtgctgggattacaggtatcagccactgtgcctggcctcccttcagtcgtaattgcattttgaaaactgggcctgcagctctgtggataccacacatgttctatttgagcctatatttctctgctggccgaatttcttaggaacctgtgccaattgtttttcatctttgatcatcagcccgaaccatgctgtgtccacctgaggggacggtccagcatctctgtgccatggcagatggactgccggggctccacctggttttggaacctgcagtttgcaccatggctctcctgactgcagagccaccggcagctgctgtgtttcctcatttcctctaaccccagtctgtggggccttccccttcagcctgctgcagaacccatccctctggtcagttgaaaaatgtgggtaactgagttggaggtggcatgaggggactttctggaaaaggtctaaaagtctgtctagaggagcgtatacatgtgtgtaggtaagaatggcatcaagttgcacactgaaggtttatgccccttactatatgtcaacaacaaccaagaaaagaatcacctgccaaagtcagtcaccacctacttagttccctagagttgccactggctcaattcatgagcttatgtatgtgccaaggggaaaggcttcctcctccactcaggttttgaacattgtaaacactaccaagcagcaaacagatagagcctgaacgtgtgaaacttaaatatctatttagtgtttgcctcctcttcccatttttttttcctttgacagaaaaattgtagtaaggggacagtgctttttgttatcttattactgtgtgtgtgtgtgtgtgtgtgtgtgtgtgtgtgtgtgtatgtgtgtagcaaagtctacatcctagaaatgtatgctgcatgccacagctgggggcctttgtgatacatgtgataggtgaaattcattgtaaaggcatatttgaggtgatttttccttattgtaattctctgtgaattgggagctgcactgaggaagtgacaaggatgaaatgatggttactatgatcagcctgttttccccaactaaacattttcacttggttgaaagctaccagagactacagtcaataataacttaatcgtacatttaaacttaaagagcgtaattgcattgtgtgtaactcaaagaaaaaatgcttgaggggatggatacctcattctgcatcctgtgcttatttcacattgcatgcctgaatcaaaacacatcatgtaccacagaaatatgaacacctcctatgtacccacaaaaattacaaatgaaaaaagaaagtcatcaggtctcgaatatactataaacatatgtgtttacagtctcttcaaacatataccaagaaccttatttaaatctcaccaaaaagaattgtcggctcacaggacaagcttaagagctgtccactgtgataatgtgacaatcccaaacgaatcttttctcctcctttttcatatttctcccttccccacattgactgaatgatatgttgtcggttccttttgttccaatcaggtagttttcaaaatttcatggcaggggaactgagttaaccaatatatacatagcctaattagctttcaagttggctttatggggcaaacaagcaagtgcgttatacaacagggaacagtgggctcccctccctcctgtatctcaatgactgggcacacaaatgcatccccatatattaactggacaacacaacagccccagctagaccagagatggtagacaccaaagaggacatcagggaacaggcaaaatccaaataacatgattctagtttaaactggattggcctcattctcaggtgaaaatgggtttacacaatgcatccctgcaacatttgtaagcttatttgttcctttacaccacgtttcattcagaaagaacgtgaaacagcccataacaatacaagcaagtgaagatatctgtggaggggagtgggctgaccgaggaacagaagggtaggaaatgttgacccagtcgggggtgacgttccagtcccaggtcagttcccgaagtttcatgtgcttgctagaggcaggacacctatttgtttctaagctttccagcaagcataggaaagggaagtgggattaattacataaatcacacaaaccatttgcatatttctttgctatttctggtactgaaaccaaagaatacaagtggatgcttggtgttaccaacatctgcacatgagctgaataaggatgatggtcatattggctctggaaccacttacagcttctacttcagatcatggatttccacacatagtaggtattaaatgctttttgaatttaacgggacaagggaaggtaatcagaaaatgaagaaagaaaaagagaaataaatgcataaagagggtcaggcttggacaaatattgatacagtgttgtacaagaaccatagaatccaacatggtacacctgagatacaaaataacaacagcaaccacaaagagaaacatggggagaatcagggaaagaaactaagaatcataagtaggaatcactaagtgggaatcaggtcctaagcaaattgctttatgtgcatttgattatttattccatcattgcttgtcagcttccaactatccctgcccaagagaaaagtgcacagacacactcagatttaggggtaggaaagaagttgagaataagaaaagaggttctgaaaggttaaggatcttgccaaaggtcacacatctaggaagaggaacttggttaccttatcaaaaacaggaaatccattctcagtttgataatgagtcagatattgtactgactcattatcccagaatacgtacaaacattctcagtgatctgagttcctggcgtattttcttttgtattgcaatctcacaaataatgtgtagagaaagaaaggaactgcatgcaaagtgtgttctttttacacacttactttgcatccaccagtttctaccctggacaaagacaggggttggagctgttatttgctgtattactgctgtactagtcccttcttgatggttccaaatacactacactctagtcattaaacacagatgttgcctggagatcaaacgctacacttaaaatcatgattcaatctgcgtttacatttagaatgggtgtaaacttgaggagaaatgctgtattcagagatattgaagacagacttataaaatataatagaattttatattacacgtagaagcgtctcagcctgaggacaagtggcactagctgtagttgccgtcaggctgaagcctgtctatggaactgggcggggtggatctaccgggagtctactgacatgggacagtgaagaaccacctgggaaaacatcactgtgtgtcaggagggtgtgcaggcacccaagcatcatgcaaatctaacacttcagtctgaaacatgggatggcaagttactaccactcagccagctcccatgggctcatcccaggatcctcgcaggagtacacgggaatttttctcttattaaaacatgtgtgggcatacctcattttattgcacttttactttattgtaatttgcagatattgccctttttacaaattgatgttctgtggcaagcctgcttagagcaagtctattggcaccatttttccaacagcatatgctcattttgtatctctttgtcacactgtcttaaatttaaccttcaactaaataactattgtattatttgaaacgttcaagtaaactaaagttttgtgaaaactgcttttcacctacttctaaaatgcattattattgggtcatttctgacacctttttttcttttttttggtgcttttctgccgatttgaagaaataatgataaaaaagaatttctataaatgtaaggatacttggttaatgtatatttgcatttcattgacaaaataacattttccataaccatgtggtctcaagcagataaattcctgtccagaagcacggtgctaccttcagcatttaaatgtcgggaggcccaatgtgttctcacattgagaaccacatgcattggaaggtggctgctattcagatagggaagatgtaagaggatggagaacaaatgaggtcctaaggagacatgtaaggcattgggagttcttctgctgcagaacccaggctgcagcccaaagggatctgagagacagctgctactgacagggaactcacacaggccacatggagctgtttccctgccatcatcatcttctggtgggtctccttgctgacccactctgaggataagaaggtgaaggagatgtccttgacagatggcagcctatgaagtaggtttctctgtgtaagaaagtcacctcccctcctgtcttggtatggggagggaaagactgtaagcctctctgtcttataaaaatcaaagatttgtggttccaaaattatatgccaaagtatacatcttggaaggaattcaatatggtgataaaactataagttgggaaactaacaaccttggtcctagtcccagatctgatctgtcactgctgactgcatgaccaaggcaaggcctgtctgatttctaagctttgggctcaatagccataaaactttactaacacttgaattgccgcagtatgccgcccctcgatccctaccatacaccccatttatgcaatagccaagtaacttttttccagctctttcttcctagttttagaaaaatacacttactagttctaaaaatccaaacaggtgcacctgactgccccagggagaatcccctgaactagtgctatctaagagaattttctgttgacaggaatgctctaaactacaatgaatgcagcagcctctagttgcaactgcccagtgagtccttgaaatgtggccactgtggctgataatctgactatttaattttctttaattttaattcatgaaaatttaaaaagtcatatgtgcctagtggctgacatattggacagtacagctctgtatcaacttttgctaattaatgtacatatccaggatcttgtactttatttgtccttttaatcaatcaaatccaatattcaataagcaaaaattactgattgcataataggaggcttcacaaaagggcagagtctagtgaagtaaaaaacatccactgtcctctctttctcttgattacttccaacatttacaaatttgggcttgccccgctgatatggtttggctgtgtccccacccaattattagttcccataatccccatgtttcacaggagggacctggtgggaggtaactgaatcatgtgggcgatttcacccatgctagtctcatgatagggattaagttctcatgagatctgatggttttataaggggcttctcccttcgtgcggttctcatttcttctctctcttgctgccctgtgtagaaggacatgttgcttccccttccaccatgatcgtaagtttcctgagacctccctagccatgcggaactgtgagtcagtcaaacctgttttctttattatgacccggtctccggtatttcttcatagcagcgtgagaacggactaatacatccagcctcctttgacttcccttttgctgatccccactgaagttaaagatgcacatttcacacgtgctttaaagattctgaaatctgcatgtttggagtaggccaggcaatattgagaagttttggtatataaacctttgagaaacttaaagtaaaccaattttctccactttttaacaatacgagtttctgtctcctaaatgaagcatttatttcaaaactcttatacacaaaactgtaatcttaaaataagggtgggggggtgctcctgactgccttggtcttctgttctgactaatcttaacaaagaaagcctcatctaataaagacaaaagtggcatcgttatgaaacttgtattgggctctgcttctgaacatatatactggcattttcctagatttgtgatattatttagtacatatttcacctaaactatgtattccacagcacattttccaatgttatggatattttttctaaactcatcttaattttccaagttcaatacaatgcatagccatttgaaaataaatgcccactaaatttcaagctgtacaaggtaaacttactttttccccccactaaatgataaacttgagtaatatatagaacctaacatttgtgccaattcactctcctgccaccccttcttcaaaatcataggtttccaaataaaggaaacaaaaacttacggctgaataccctgctccaaattaaacataaagtaatcaaagtcattattaaatgtttttcatgttgtcgaaggaaacaaaacaacaggaaggacaagagtttaggtcaagaggttccggtgttatctgcgtccttcattataagtgatttcaaaatctttttccctccaggaaaaactagtgagtaacagcttagtctaaatgacagcagctctgtggtacgaagggtccacatttcagctaattttcagctcttcttatcctgataccatgagatggaatttaatagatggctggaacatctataacatgacatttaccaaaggatgtgtcagcggcatccatggcctcaacaaagatggagccttcaaaacataaatcaaagaaaaatataagaacatcttagaagaaaaggatgacagtgatcctgcacatttaaaatattttaaatgccttagggactctacggagcaagtagtgttaaaaataatgatgtaccaactaaagatatttagctccctgttaagagaagaggctatgtagcagaaggagaaaatctttagattttttttttcaaaacatgtggtttgagagcccacctcacactgttcctttggtaattctcttattctctgtgaaccttgtatagttttcttgggtgtaaaatagtcacaggattcccaaccttacccaattcacatggttattaaatcaataaagacaatgtgtgtgaaaatactttttgagctgtaaaaggctctacatgaaaagcttatgtaatagaatattaaattggaggtttcaattaaagccagatacaagagatactataaaccaaaagaggtgctgattgcctatgtgaatttacaaatctaaacatcactgacataatttttttaacagactttttttttttttagcagttttaggctcaaagccaaatcaagcagaaagtacatccttttcttccaaacatgggctattttgaaacatctcatgaacatcatatttatagattggtttgttggagtgagtggagataatgtttgaaggtgagataatgtttgaaggtgatttctttgtggaagaaaagggcttctatggaaagactccactcagagagcttgatatggctcttctagagttaaggagaaacagtgatatgatttggatctgtgtccccacccaaatctcatgttcaattgtaatctccagtgttggaggtggggcatggtgggaggtggttggatcctgggagcagtttctcatgagtggcttagcgccatccctctggtgctgttcttgggatggtgagtgagctttcacaagatccgtttgtttaaaagtgcgtagcacctcctcctcactctggacaggtaaaacatctcacatctcctttgccttctgcggtgactggaagcttcctgaggtctctgtagaagcataagccactatgcttcctgtacaggctggagaaccatcagccaattaaactccttttctttgaaaattacccagtgtcaggtacttctttacagtaaggcaagaaaggactaatacagagagtgagttcaggtctgacccgagtcccacttgataatgttaaaggctagctactttgttggtatagttatattgggtttagtctgtgatcccagagtttgttaaaacaaaatatgtatgagaatgcccaatggaaaatgaaaaagagctgcactgaaaccactttagtttctacccaagatgtcctggaagaccaaggagactccaacagagaaaatcggggtggataacagtgaaaaaccagcagctgagaaagaagtgatcaccggaggaggaacatcagtatatgcttggaggtgaagcagacatttcctctggtgacctctaaacaacttgtacaggagccaatgagataaagtttgcttttcacacttcctacacttgacagcttaaacatatcccatgacagtgtcagctgagtgagaactttcctgtgccctcttgctaagctcctaaattgtgcttcaacactgaggtatcagaaacagaagagagcaaaatggcagtgcaggggagcaagttcaaggtggggaaggacggaggatgccccccaccccaatatacaccacccctccagcaagtgcccagcctaatgcaggcccagcaggagtacatggcaagctttttatttgtttagttggttgttttcaagagactggacactactatgtactgaaataaagctgtaattgaaacttaaagttatccatttggccctgggagaaaatctattaatataacatgacatttaccaaagaatgtgtcagcagcatccatggcctcaacaaaaatgctatctgccaggaggacatggaaactcctttagaggagacaaaagaatcctcagtaaaaggaaccaccaccagatacagcgtgatgggttgtgcagttgaagctacaaaaggtttgtcttggacattaatatggtttggctgtgtccccacccaaatctcatcttaaattgtaactcccacaattcccacgtcataagaggaacccagtgagaggtgcttgaactatgggggtgggtttttcctgcactgttctcatgatagtgaatgagtctcatgagatctgatcattttaaaaagaggagttccctgcaaactctctttttgcctgccaccatccatgtaagacatgacttgctccttcgtgcctctcaccttccaccagaagtgtgaggcctccccagccgtgtggaactgtaaatccaataaacctctttcttttgtaaattgctcagtctcgggtatgtctttatcagcagacatacagatataccgggagctgctttacaaaaatcaccagtaggcatgaaatttccagtggctcaacacgtcccactatgaccaaccctggtgataagctcagtgtctgacacagtggctgccacacctgctcgctctgaattgtcatttccaaccctgcctcttcattctccaacctgaacaccaacatcattccacaaagaaggccctgtgtacactctgccttttccttctctacagtcagtactggatcaatgtccacataggccctatccacaacccaacagcaatctcctggtcctacttaagagcacattcaccttctaatttcaggatcttctttcatagtcttgccatacctttcgtggctccaacgctgttctttgaaaagaaaacttctttgaggcaggagaatactctgtccctttttaatgcttgaatcgtaagtttaatacagaaggaaagccctaggaagtaaatcattgtagctgctttaaacatttgaagagcctacaggtggaacattccttagatttcgtttttttttttttttttaaataacaaaactagaagaatgggtggaaacatttaggtcagataactttctctcaagctctttaacaatgaaaacagttttgtgaaaagcaatgattattcctttactcaaagtgctctagcaaagtcagatgactacaaagcaagcatgtaagagtaattatcttctataggagggaattgagattagacgactgcaaagttgattcctattctaattatcttctataggagggaattgagattagacgactgcagagttgattcctactctaattaccttctataggagggaattgagattagacgactgcaaagttgattcctattctaattatcttctataggagggaattgagattagatgactgcaaagttgattcctattctaattatattctataggagggaattgagattagacaactgcaaagttgattcctattctaattatcttctataggagggaattgagattagacaactgcaaagttgattcctattctaagtatcttatatcggagggaattgagactagacaactgcaaagttgattcctattctaattatcttctataggagggaattgagattagatgactgcaaagttgattcctattctaagattatggataggccaaggtatacaatgactattatatcattcattatcatagtcattgtataccttggcctaccattaatttacttcatgaaacatcttaaacatcaaataataataatagtaataagaataaaaatatctactatgtggcaggcactatgctaagcaccaaagtatggtccctgccccaaggaaatgaatctaataagggagcccagaacagggggacccaaataatcaagacttaattttttggtcatactccatttatttcatgaactctgtttatgcaaagtttatatttttatgataacattgaacaatagacatattatgtcatattggtttatactgacctttacctaaagtactttaaataaaaatatcctattcagagacaaagacaaagagcatggttctcatttgtttgtagcacattatgggaggagtagagttcatttctccatgagatactactgctagctttaaattatggccatctctgagtgtacgcttattagcatggcattctaaattaatatgaaattctgtatgcacaactgaagattcataacacattaaaaaaaatagggtcattctgacactagacagaaatataattctttgaaactagccgtgggagaacccgtagttcaatcataccaacaaatgactgaagggttttaatcatactcagagattcaagtggaccatgcccagtgcatgccatagactctggcatcagtgagtatcgtgccctacaacaaacccacttggctaactagtcactttacaaatcatattctatgagcatttcccttttaattttcataatttcctttttcccagtacgcaatactcttccattttcttttcagcaagggaaaactccatgtttcacttctaatccagttctagaatcttaatccccactttagaaaacagagtccagtgaattttactcttttcagggaaagcctgcagagtaagtgtcaactctccctcaaccttataagaaaactaatgtgactcaatgtgagtgctttcagcaagaatctgagctcaagttccccagattaaactctcagtttggtttctttctcgccgggtgacccaagtaaagtcaattaacctctccgtttcccacccggctttactgatgcatttacgcaggtagctggatattcccagatggaagagcatgcacgcatacattcataatgcaaactcatatcacagtactggtctgtactggcttgcctcattctgaagcagtattttcagggagactcccctgccccgcacattttatcactgtaagataagatatttgtttcttataaagcatcaacaaaggatctactatgtaggaagaaaaggctactaaattctatttatgtttccccagtgagatttttgagccattcgcttcttaagcacataaattaacccactgccctacagatgtagtttttacttccacaagtcttgataaagctcctcagtgctcaaacggataatatgtcagtttcactctgcagagactcaggaaggtacatctatgtgtagaaacaggcactggagaaaagtagcatttcacacacaaaaacagtttcaaggctagccaagtctagtacaggcaaagtgatacaaatagggcatagaacagcagggtttccacgcaggaaagaaactgatgagttcaggaaagtgggctaaaacggtgatgcatttacaaatgtgatagtcgctgatcattgccaacccaacgtgcttctcaccctctgtccttgctcataggaatccgattttttttggagatggaatgggcccagactaggggataaaataggactggtctaagccaatcatggcaattctgtttccatgtggcaaacacttgcttttcaacatgcttcgttactatcactggccatatggcccagttataaatgatgagctgtaaggagaggcctattaggaggcttctaagaattatctttttccattttgtttatttttatgtatttatttatttttgagacggagcctcactctgtcacccaagctggagtgcaatagtgccatcttggctcactgaaacctctgcctcctgggttcaagtgattctcctgcctcagcctcctgagtagctgggattataggcacatgccaccacagccagctaatttttgtatttttagtagagacaggttttcaccatgttggtgaggctcgtctcgaactcctgacttcaagtgatccaccgacctcggcctcccaaagtgctgggattacaggtgtgagccaccgtgcccggccagaattatctgttttatatagaagagacaggcactgctgtgtccgttgttatcctgccttgcacacagaattgatgccttgatgctctgttctatgccatgaaggacagtggctagtaaagctagaaacagccccgtcagtgtgtgagtcaacaagaatgtcctgatgggtttatctgctgtgtgagtgcctgatccctgccaggagacagcatcacgaaccaataaacaaaccaaccaagtttttaaacatgatacatacatgtaactacaacgtaaaatgaaacaataagacatatgaaaaacgttctttagagaaccttattttttcttttatgctttgtaggtactttaggttgagttttctcaaacccttctatgtagtatcaagaaatatttctcttataaatattttaaaaatgtatcatcctgcacaatgaataagattgtagatcacttaaccaatttccaattatctaaattaatgactgcatgtcactactaactgacagactttgtaaaacttttaatatcttttacataaaaagtaagtaatactggcttggtgtacctcattgccataatgatatgcatatgtgaaattagaaaaagcactatacaaatatcataacaattaaatatttaggtaaagtctgagcttagctcatgatttatggtaagcattcaataaattatagggatttttttttttttttttttttttttttttagataaggtctcgctctgtcactcaggctggaatgtggtggcatgatcatggctcactgcacccttgactttccaggctcaatggatccacctgcctcggtctcccaagttgttgggcctacaggcacatgctaccacgcccagctaatttttttttttctattttttgtagaagcaggttctcactataatagtagtcactccttatagtatacatacaacaaaaccatgtactttggaagtaatgcaataagtaacatgttttaaaatatatacacatactttttcagagtaatatgcttttaacttcctgcccacaattttgagaatttcaaactagcagcatgggtcaagcgcatggctgggtatcaaaacaaaaacactgagacactctacacaacaaaatgcaaagcgacatctggtatgttcccatctctccagggtcctcatgatgctgagcttttgagcattctaaaggtacacttggggaacttgcgtctgcaagaccgacttctttttctgtctccctttttcttaaagagtagtgagtaaaatcattaccaaacaaacaaaaaacagttatcattacagagggatctctattaaagaagcaatgaaaggctagcactactgtgggctggatgaaaataaatagctggattgaaaagtcaatgaattaccaacattgacccacatttctctagactttaattaactgacatcatcccaatgaataacatatgataaataaaatcttaattctaaaatactaggcaaaggacaaaggctctcaacgtacgcatttctgtgatacagaagagtaacaacgaattggctaaaattgccggcagctcagctagataccattttacttatttcagatcaatgctgggtttctccctcttcgccaaagctgaatgtgcatcactctggcttttgcccaggtccccacatagactttgataaaatacttactcagtccaccttcggctatcactcctccctgaactcgtctatcccctccatcctcttcttctcttaactatgcctctgctccatgagaccctcagctaaacattggaggagtctttgagagccattcaaatgatctgatgttttcctaaaaattagtgtctttgaacaaatgaagcttttgtgacctatacatgtgtgtcctatggccatttgtaggagttggttctaggaaggctgctgaaaatccattcaccaaaggctgattcactggctggccaacttacctaatcgtttactcaaaagttctaaaatttgattatttatgaactgcacagtgtggtctttggtgtcctgagctcttcaggtcccctcctggcccctcagtgtacaactgcctggagctgttgcagaagggagcaggggcataaacaatgaacatccctaaaatgctcctaggaagagaagaggtgttcacctataacctgaaaagtcctggaaattcaatataaaatacagaagatcctaaaagctgattaaaagaaacatatttttggtaaaccaacaaacaaagaaaatgatttggaaaatgttttttaaatctggagtaacagaaaaacaactaaaatagagattagaaagaaatcggtataagccaagagttcccatatggaattttgaagtttaggttatatttataacaatagacgtacaagtatattaaagaagaaaacgttcttaagaagatgaattcacctgtatttcataactttcaacaaattgatcattcattaaaatctgctaagaaattattgaccattttgagaataatcaaatacagaatacaataaaaatacttgaataaattccaaaagaatgtttcaaaacaatattattccttatattagtaaatgtggtaaaaatcagcaaaatagtaagtgagaaaattcaatggtatccatatgaggtgtgtgttggtggaaaagaacatttacgggtttgaaacccaggcatgaattatcaaaatgagtctcaagaaaatggcagtagcagcatttacttacaattttaaattccttctactggctgatactgatgccctgaaatggtttcgatcaaccgtctttaaggagacccctttacatatatattgtatacagtatgcaaattctaaatgtaaactatcaagaataatacatgtataaaaaataaatcatcaaaattttaagttctttatggtaatccttttttatatgtttatttttatatgtttactatgttttttatatgtttatttttaccttaacctggctcttttggaagtattagctttggtaaaagggaaaaagaggaaaatattttaacctttctcacttctctatcgactggctctttgcgaggtgagtgtgcatcatttgtgtgtggatgagagcccgtgataaggaccaaggagaacacaagcaaagagagtgggcgtgaaaaggagatgaagtaagaagcgtccacaaggccaagagaaatctcgtggcagaacagatggtggcgtgaagggcgacagtgaacacgggggccaccctggctttggtagatgccagacatgcattgtgttctgcacactttccaccctggagcttatgaatccacacagaaaccagcttcgctgtagatttaacactgtaacgcgatgcaaaacagaatgcatggtggccggttccactctcactgtcgggacatccaaaacatgccctacaaatactgtcaataacataaaataatgcgtaatgcctcctccactgtgctttcaaagcactgaaacgcctgataaccaaatctacaataagcaaagaggggatatcacacacttaggcaaaaacaccccatgtgaaaactagaaagtaagcttaggtctattctaagacttgaatttcttacataaatgtgagagtaattttgataacaagagaggtaagaagactcctggccaacaattaatctgtaacaaatattaagcttaggaatgattttacatttagactgtatttcttaataaatttcctcacataaattgtgcctaatctataaactaattttaaacaaaatccatcatgccaggcactttacatcttactctatttattgcaccatttctcatcagaaaccttttagctttaatgctattccatggcagagtatctcattagagtggcaaagataaagttctttttgagataaagtaattacggtgattgtagcggggagggggtcacccaaagttcttggctacagtaatctcctggcttctgattcattttaagaccaataaactgagtacaaacaaaaagatgttaatggtggataactctggttacctagagtttgtcctggagggattagcaattcataaccttaatcagaactagagtcctggagaattttgctcccaggaaaatatttcaagaccagatgctgtatgtgctctcagctcacttctatgtcaattctatcttctaattattattaaagtcaatcaagtatttcactctataaaaagccttactatattttaagccaattttctgttccaaagactagtcagttacttcctatcccaggggctttgctttcttgaggaggcacaagtcagttgaaatatgggctatggccaagacaatgatagtagcaagggacaggactcctcagccatgatcagaaagagtactgttaggatttagtgagaagccttcaggggaaggaggaggcttggttttcaaatcatgccaagggacagacttaccattgccatggagtcaaattaaccttaccagcccagtcaaaataattaaaaattaatacagtctctgataaagtttgttgatataaattggtgctagggaaatatttcaaggaaacaatgacatgagttattttaaattattaatttcattggtcaggaacccaatcagaattaaatatgcacatataaaacaacctcccttgtgtgttcaactctgtctcatttctgcatggacctcagtggatgacttttgaagaagcagatgaaaagtgaatgcttgccaattagctattgttcaccgttttccagtaagcattcatatttctaaaggattatagtctagtccaaactctgatcaaggtcaccatgcaagaaagaggatattctgatatggagatgaagaaaatttgagtccgggttggttctcaacttacctatgaggtcaggtgaaaacttcagacatcagttccccatgcctaacatcaggacaaaattaactatccatttcctttacaatttgttagagtatcatattaaatgtgaaacatgattaaactggagcatcacatttgaaaagcaactcattattattacatgtaaattttaaatagcattcaggaaatgttagaattaagaacaaatcaccaataaaaactttagaagattaccatttagactcatgatatgagtggatctcgttgcaaactgatttttccaaatgagaaaaaatacaattatactttcaaaaataacccaggtggctaaccaggttccagttttcctccttaggtataaaaatcttgctgaagttcacataaaccacatgctgctcacctataactagtcagccacacaagatcctatattgtatttttgttcttgatcagagacaattatgtaagttatcgatccttataaagttctagaaaatgaaacctcagaattgcctattattcacacagcaatctttacacttggcaaagtttagcacctactccattattgcaaagcctaaatttgctggtgaatcagtagtgtgactggtcggctgatccacagaaatattatttgtaggtgttactgaatgtgtatttttgttattgaaaaattgaaacatctgatcttctcctatggactagctacactagatctagttactgtactaaaatatggattatataagttatctttgatttaattgtccctaaatccataagcatatttttttcaagagtatgtttcagttatattttaagtacaagggaagtagttagaaaatagaacactgattactagatttgtatagtgaggactatatcctagtaaaggccagggctatggaaaaatacaaagcagatttttcactcctggcttcgatatttatgaactgtgtaactttgggctcattacttaacctcatggagtctctttgtaaaaacactggatgagaattggagaaaaatagaaatacaagaatataaggataaggaaggaaatcagtacactgtagtgaagccatcataattgctatgcttcatttcattatatgatgccagacagaatttctaaagggtatgaattcatggagtcaacatagaaaatttcgaatacaaatgctatttattcagcattacttgattcgtgtctttctatggacaaggcactttgtgaggtgttaaacataaactagagacccaagctgaaagttatctgatcttataacaaggcttacaggctcttcgaacatagacaagtaaggacactttggtagaatgaagggcaggaagtgaatgatacctgcaatactggagttgacattttggcccctcaggtaggaaatgaagagaggagaggccaacagctctagaaaaacttcagagaagggtcaatgatatgcagagcagaaaacagtgcttggggaagaaacagcatgaatttaaatatcaaaggtggagcatctctgggaactgagaaaaatcccaggtggtcacatgactgggctttggagatagaggtggagccgagactacaaaacacagggattgaacatccctcccaggatgctgggcctggggagcagggtggcatgacatcatcacagagcctcagcctgagatggaaatgctcacagcctcttgatgcagagcagtagaggtaggggtggttttacttctctgaaatcagttagccaaagcctagattgatttcatacatgagtatatataaatatatatacatacatacataaaatagtaatattaatagaataacaataaagaattttacatttctaaatatttatgttctggctactgttctaagtactcttcgtaaatgagctaatctgcacaaaaggaaatagatactattgtaccattgaatagatattaccaagttggcataggtaagagcaaaggaagtcaggattctaatggggcagactggctctggctaactgatttcagagaagtaaaaccacccctacctctactgctctgcatcaagaggctgtgagcatttcttaggctcacaggtcatcacctctcagccaagccttactgttcctgaggattacgacatgtcaggctctggtaagtacctactattaatgtaccatttagtccccacaacactctattttggcttgttatgtttaggccaatgctacaggttggttttctttctgtttttctatttttttcccacacaaagcatattattaaatgagaaatcccatgtaaaattccagattgatgatttcttttgattaaaaagaaaacaatacagccatactgagtttccctctcacctcttgccagcaactggcagaagcgacttttcaacatgaattccacctcacccttccactactgtcctcaccgccccctactgcccacatctaacctaacttctcatcacctgagtgatcactgtggacatatgagtatgtgacatctatcgtaattatatctgtgtgttaaaaaaaaaaaaagctgaaaagctaaaggagttaaatgtttagattagacagtccaggttcaacctccaagtccacactcataagttcctcttttcttgggcaaatgccttaatctctttaagccttattatcctcacatctaaaatagggttactaataatgcttaactgagagtgttcttatgaaataattaaaccagataatgcctgaaaagaatttagcttggaattcaatattcatttttattgccatttttaccaagaataccaggaagttggtataaataggtcatatatgccacctaaagcaatcaggacttaggcacagattggggtagatgaggttgtgtcttgtgttgagaaagccagaggagaggagcaagtggaagcaacccctcttggggacattgggcctgcagcatgctgcccggcaggagagctgcccaagaactgtcccagaaagagccccgtgggcatcattcttgtgtggctttgactctataaatgaatttctctagacagctgaaatgttcatcaaagtgaaacactgaatcacagctttctgtaattccaccattttctcaggcctgagaagatggatccatgatttctcctttattaggtggatcttttgagttctttcacaggccccgtaacacccattctacagggctgccaccttgaccctggcccacagctcctcatctgcgaaccagatgaaatgcgccttaattagcctcttgtctttcacctgtccccatcttcaagtctaatggcaaactgtcctcagcatgaactgtcctcaatagcgtttgacacatcaccctggtttatacaattttgctgtggtttccgtcagcttgcagaatagaatctgaacatgccagtcatcactggggttcctggctggtgcctggggtatttacccacacttgcacacctgactgcccccagcactgtgtccttgacacccccgtgtctgtgttctctccaccgcggggactggacacgctcggcctgcatgccctctattgcaaccacatcacatccagccaaatcccttggagccaccgagccggaacctgacactttctatcggggtcagcaaacctgttctctaaagaaccagtgagtatgtattgcaggctttgtaggccacccagtctgtttcccagctactccactctgcacttaaagcaggaaaggagctgtaggcaacatgtacagaaatgggtggggctggctctccattaaactttatttatggacatgagaatgtaaatttcatgggtcacataatgttattcatcttttgatttttcccaaccatttaaagccataaaaaccaactttgcgtcaggggctgcacagaaacaagcagtggccacagcagacttcagttgactgacccttgctttatatgcatactgtttgctgatccatactctttttttactttttaaaattaaggtataacgtacatttggtgcaccaatcttaacgcaacagcccagtgaatgttgacttttgtatataaccatgctaccatcacacagatcaagatacaaaacatttttagcagcctaaggttcctaaatggtcccttctaatcacaccgtaacagaagcccaacctctttttgctgccaaagcactctccatacttcctttcataggcctggataaagtaatggggaaacaaccctgtgtaatctaaactttcacagagcagaaagaaatccagaagacaaaggcgcataaacgaaacttcggctatcattaactatcacaaccacagaagagaatgtcttttcttttcaaagacgggtgatacatcattagaaaaactgaaaggcaatgtgttagtacacattcattttcctggcagtctcatgctgacactgcatttccttacctgggtcaaggtgagcgttgcctgcctgcaggtgctgcactgtaccctgagttttcccggctgcactctttgacaggggcctttgcaatacacataaaagctgttgtagattgatctacctgctggagaagaaaaagcagaagaagtggctaataatgctgcatctaaattgagacaagaaactctttaaaagcttgttagaggcaaattttaaaactcagtcttcaggaacattttgaaacattactggaataaatattccaatgggaatacaacaatttaatttagaaaatctaactttatgctccaagagtgaaatcttttctctctcttgccaacagccctgtgacttactcagcaaagtaagcagcctactgccaagagaatcgggcaagtgtatctgcaacacagtaaaatcagaggcactctttgccgaggaagtttgaaaagatgacaggaattctttcaggatgctcctgaattctatctcgtgcttccagacacagttttgaagactgcagatttttcctcataatatctacagagaaaaaccagcccatttatcgtgatataaatgatatgatcacagtttgctgggcttctagggttgactttctaactcacagtcacacataaaataagaaaagaggccaacgctgaggaactttcagagaccaagcagctatgtgcagaaatggatggtttgcatttcatttatgatctctctacctaggcaaacaccattcaaataatacattttcaagagtaaaaggtgaacaaacaactaattcaatagttcaatctcagatcatttctctcaactgtcaccatatagggacactctgtaaactagggaaatttaatcaatttatacttccatatctgttaagaattaactttattcagaagcacttaccagaaatacaaccttcttcctgaatttctaaattttgaaaattactaaatagttttttcttttaatccttacctgggtggataatataacagatcatgacataaaagtttctttgaaattttactatgatcatcagaggcacctagagataatatatttttttttaacatttggaatgaaaatcttcagcctcacaaatgcatatgatctattaaaaacaactagaacaaaaataatgaaaaaaatgagattctaaagtcctttgcagcttcatttcccgaatttacaaaaagagcttttgcagacatattggattatcatttgtttagctatctttcctaatactgtaggtgacaatactttgcaaaatctgaagcacaacaaagatgtaaagtttcatggttttatcatttgtttgcaatatattttataattattactctataaagattaatatttagtttccagtgggaaatggaagataaaatgtaaatacatgtttatattgatgtgaaagtactattttctgacacttctgtgtaactttaatgccctaatgtacaacatattcaagtacataaatatgacattgctgttagcaaacataataatgacataaaatgtttcacatgtaatatacatgcagcatagaaccatgtattaatgttatagaaatatttgtaacaactgactgaaatatctgtaatatgtaagtaaatgttaatggaaatatttgtaacataaatatttgcaacatgcagagtatcaaaagatcacaagaactgtgacaattctgacgtgcactaagaagtgcatagaagaagaagtgcttagaagaagaacctttactgttaaaacctttatcagcaacaggaacaaatccaatttcacaatttttataaccttttgtaaaggtcaaacaataaaaagaaaaaaggaggaagaaaaggaacaggaaaagcaaaagctttgaaaggggagtcagggctgcaaatacgctagcattgttgaaagagcatattagcaagagttttacaatattaaaagaagcatctcagaaattgcaggaaactaagtgactcttctctctcccttaaggcaatagtgatgtttgcaatattgtttcagctaatgatatatcaacgcagaatctgaaagctaaggaacttttccacctccgaatgctactaccttcgctgaagtccttcagaagttattcagaaaatactgtatgccaatgtctgtgccctagaagcatacaagatgacatgcaatctattacacacactgctttccagacccagccacaagttggggattaacagccagtctaaggaagatcaaggtcaggccagtcgtggctgcagcgcttttcaagctgttggctccacttggtcaagcagctggggcatcaggtaaatcttgagagcccctccagaacggcttccctatttatttagctacataacacaattaaaagttggcaaggttttctgtgtcatgctgtgacctggacaggcatgaaaacaaataacaccccgacaatcttctgggcaaggttcccatcggcctggctgaagggcctaaagtagaaactcttgaatatggagtcataactcttagaggaatggcaaggcaattccaaaaatgacctgagaaacctttcttgtggtatgtagctgtctctagtcaatagcatgaatctcaccctttcacttgttcttggaccttaaaatcctttctctctcctaatcaactcttctgtatggcagcttcttgattatcccaataactaaagtagcttatgtttgtgttcataagagtttcctctttttgtatagtaagttttgaaacatagagagatatttcaaaaattgtacaaatcacatccttcattgtaattcatcacttgcagatatttcgccacgtttgggttccctgtgcgcgtgtgtgtgcatatagctgtgtacacatatactacatgtataaactatttggttgaaggatctgtaacacagtttctgacatcatgctacttcacctctaaattcttcaacatcctaaaactagggatgtttttcatataaaaccatttagctttttaagtgatttggttattttgtagttctattcatagactaatcaggtatattttaagtaggcattacagaaaatgacagtggtttgcaagctaataaaagatgacaataaaaaatattggggattctctcgtcaaaccaatttaggtggtgctaagtgaagccacattaaacaagtcccctgaccataccccttctcagagctgagtgactctgtaaaaatgaaaggatgaagcacaggacatctcaaacttctcctgaccatagatgccttcctggaatgctgcatcgtgtgacactgtacttctcagaaaaaaacaatttagaaaaaaatatcagatgaaggattcaatccacttgtagggcttgatttatagaaagtgaaactgctcatgtttataaacccagatttaccaaattctcctggatatctgcctacggccaagttctttcctccaacccaaaacatcaacgaactcatataattactttgtcatgtgccaggaggttaagtctacttatgtaatgattttgcaaataaagtatgttaattttattcagaagttttgttttttttttttcctgcagagaagttaaaaagaaaagtgtactgagttcagggcccttttaaagcgtgagtcaccgtggccattcagaggtccactggctttctaccattccttagcctaagaagtccatcttcttcttcttttttttttttcttttttcttttttgagatggagtctcgctgtgttgcccagactggagtggaatggtacaatctcggctcactgcaacttcctcctcttgggttcaagtgattctcctgcctcaacctcctgagtagctggaactacaggcgtgcaccaccacacccagctaattttggtatttttagtagagacagggtttcaccatgttggcctggatggtcttgatctcttgacctcatgatctgcccacctcagcctctcaaagtgctgggattacatgcatgagccaccacgcccggccaagtccatcttcttctttagttttctctcacgctttgcctaacagaaccctcagtcaaatcttctcttttcctttcttttcttggtcaaaaaagttgctgaaataacaatgtttacaacatattgaatagagccaatatttgaaaatagtatattttatttgcttgggattttttagaaaccagtataatctttacagttatcatttttcttttatgtattttagataataggcttaagggttgaagacaggatacttaggaagagtcgttctgattctaatggaaacttttcattaacctgagaagtttccatcactagttgtcactgagaatttaattgctgggataatttgttttctaggtggggagagagtaagatttaacatatttcttaccttggtaaaatactgttcagtatcaacatattgtaacagagcaaaacagcaggaacaggacggattttaagtgatatttatcacatgagctattaaaatattaagtagaacaatgtcacccaagagaactctctgcaatgatgaaaatgttctccatttgcactatctcatattaatatatacacacacagacacacacacacacgtacatagcatatgtagccattagctacaactacctatggagaacttgaaacttagtgaggaattactctctgagttttattaatttaaagtagtttcaatttaaatagctgtctgtgggtagcagctaccaaactagaaagcacagaagaagagaataaaaaccactggtgtggctggtcccctcttcaactgacaacgcggagactcactgggcagtgaaacagcttgttttaatctgtgctcatataaaaataatgttggcccgagagaaggagaaggaagaaggttttactcgtggcactggggtaggacagaaacaggggggacttccgtagtgctagaagcagagaaaaggttctcgccatcatgtgcccttatttcctacaccaaggggatctgttcttgagacgcacctggacagcaatggctccatctccatttccatcaccacctttgaaatctgacccatatgctcaaggtacagttagactggcacttcttgtatgatttctgcccttgatttccattatcatatgatatttccctaaaaatgacatctaagagaaggaaagtagccagtgcagtctcatcctcttcgaacagctggcttgcaccaacaccacagaaccagctactgataaggagctgctggcatgaggcgtcccccaagcctttgtccaaagccccccacattgccaagcctggctattggtggtttcagctccttccctctttcctccttctgactacagagttgtccttgtttcttacacatcaagaatgctgctgctggtgtcattagctctcatttttcagttacacctgccatattccctcagttcagccctgcgcctagtcatgcagggagtcacctcagttctggtggagccctggattctcctgtggaatagatgcatggccagagtttctggacccgggacagggatctggtcagaagtaacagcaggggcacagaaccttcttcctcatcatccatcaggattattgctactgtatttctgggtgctggccttcagcagggcttgaccacatttgctggaatacacgtctccacaaggacacaaccagtatgtaccaaatgaacagaatcagcaccacctctgatgtccagcaagcgcttctttacacattatggagagagaacccacttttcttcatgttgagtgaaggtattcattagttctagtttaaccaatatgtacagaaatagtccaaagtggttccacatgaaattcatttggactggacttcctgaatcacctcttctaaggacaccttgctttggagccttaaaaagatggggatcggcctgccgcagtgactcaagcctgtaatcccagcactttgggaggccgaggcaggcggatcacaaggtcaggagatccagaccatcctggctaacacgatgaaaccccttctctattaaaaatacaaaaaattagccggcttggtggccggacccctgtagtcccagctgctcgggaggctgaggcaggagaatcgcttgaacccaggagacggacgctgaagtgagctgagatcccatcactgcactccagcctgggtgacagagcgagactctgtccccccaaccaaaaaagaaaaagatggggataacgaccatttcaccattatgcaggttactgggggaaaagttgctaaactgggcaggtcaaacacggaggcttcattatctcactagaaatctccctctagggagccacagtcagcactctctggaaaggtcatgcagccaaccgattcacttgaccgtcctaacatcccactcagcgcatggccccgtgtctgcccatctttccgtctcactatgtgagtggaccactctcttcagttgaacgcttccttccctctccttctgaaggctcatgggacctcatgtgcacaccactggccctcaatgcgctcaccttgacctttctgtacctgtccaaacttttctatggatacaacctctctgtgtgtaacacttcactctatttcatatgctccaaatggctagtgaagttccctgaactcaataaacactcaataggtatttgctaggtcaataaattctcccatatttttaatggggtgaaaactgaagtgagcatggtggtgtcagggcaacaaatataaaatagaatgcagccatgatcattcaatatctagaacatctttcctaccaaccagacaccctttaaattgttgggatatcatatttgaaatcagtaaaattaaacattagaaaaattacttacataagaactaaaataaaaaaatgtttatataggacttggtgtaactgaatgttaaggagaaaaagtgaaattctaagtttaccaacaagtagaactattctaaaggaagacagttattacatgaacactcttcactccaaaccttgtccaataggttattacacccaactgaatcaaactgcctgttccatgcttttaacgagccataaacttaactcctgtggagtaaccaaggttatgctatattgtaaacagcttccaattacataaccatccatccagtgaatgtacttctaaaaaatacttctaaaacatgcttagcaatctctaaggagactctacacttaaaagttataacttaattctcaaatttttgctggggttttaaattaacgtatctgcacaataatttgacctactgaggcaaaaactgctgattaaatctaatacctttttctgattttttggttgttgttgccaatttattttttcatttttcattttgaaaataataatgaaatttcccataccaagacaaaactgtagagtgaagcaaaatttaagaattaggtttaaataaataacaaagtacaaagccaaaaagagtaaatgtagttgctttttctttcagaaatggatacgggccaggaaatgggcacagttaaggtggtgccaggaaagtcacagctttccaaaagttgaataaactccataatataaatgtagatggaagaaaccatcaatgctgcagataatgtgtccagtttcctcacaatgacatctctatagcctggggtatgtccatcttggcttaaagaggcagcacctatgggaaaactggctagccatatgtagaaagctgaaactggatcccttccttacaccttatacaaaaattaaatcaagatggattaaagactaaaatgtcagacctaaaaccataaaaaccctagaagaaaacctaggcaatgccattcaggacacaggcatgggcaaggacttcatgactgaaacaccaaaagcaatggcaacaaaagccaaaattgacaaatgggatctcattatactaaagagcttctgcacagcagaaactatcatcagagtgaacagacaacctacagaatgggagaaaatttttgcaatctacctatctgacagaaggctaatattcagaatctacaaagaactcaaacaaatttacatgaaaaaaacaagcaaccccatcaaaaagtgggcaaaggatatgaacagacacttctatgcatccatagaacagacagctatgcagccaacagacacatgaaaaaatgctcatcgtcactggtcatcagagaaatgtaaatcaaaaccacaatgagataccatctcatgccagatagaatggcaatcactaaaaagtcagaaaacaacagatgctggagacgatgtggagaaacaggaacgcttttacattgctggtgggagtgtaaattagttcaaccattgtggaagacagtgcagcgattcctcaaggatctagaactagaaataccatttgacccagccatgccattactgggtatatacacccaaaggattataaatcatgctgctaataaagacacacgcacatgtttgcttattgcagtactattcacactagcaaagacttggaaccaacccaaatatccatcaatgatagactggattaagaaaatgtggcacatatacaccgtggaatactatgcagccataaaaaagaatgagttcatgtcctttgtggggatgtggatgaagctggaaaccatcattctcagcaaactatcacaaggacagaaaaccaaacactgcatgttctcactcataggtgggaattgaacaatgagaacacttggatgcagggcggggaacatcacacactggggcctgttgtgggatggggagaggggggagggatagcattaggagaaatacctaatgtaaatgatgagttgatgggtgcagcaaaccaacatggcatatgtatatgtatcaaactggtatgttgtgcacatgcaccctataacttaaagtataataataaaaaataaaataaaataaaataaaataaagaggcagcacctctctggagccatgacctctttgtcaaaccctggcctggccttgtcacctttgggaaatcagctggccctcaatgcctgttctctcatctgcaattatatgtctactattattgtctcagtagacaataatagtatctaactcagtagactgtggtaaggattttaaaaataataatggaggtgaggcacttagaacaatgtctgctatacatggaatgttcagcacatgttgtttatttgtatttgctgccaaaaaaattctgaactcaagctcctcccacggattcttcaagctgtaggcatttacccctcctacttcctcaggtggctactttcctgtttaataaatgttgattcttagacagtatttccatcttaaatccactgcatttttgtaaatagaggaaatataaatcttaaataattctttttaaaattacttcattcccaaccaaatcctttacaattaaatatttaataatattatggaacacaaaccctgatggaaagtcccaaaattgattgaaatttttctagaatcatatttgtttctgtgaatcacttttttattatgaggtaagagatacaggggtggactgcagaaaagttaggaaggaaaataataaacaattacatgatctagtccagttgataaaattttcaagttggctaatatgctttaaaaaaaagtatttccaaaataaaagctttttttattgtatggttgtggaatggtactaaaggggattcaatatgtatttcaaaatttaatatgaatggcagacttgttaaatttgcatccactcttctttgaaaggtaggtacgattgtcagcatttcataacaaagaaaacacaagctaatgggttgaatggtgtccccaagacagcactcggggtcatcagagatttacaggtaagccttcctcattagaaagcacaagctttccttttaaccacatgataataaccttgagtcagacggtggactttacaaaatactgtaggggactgattccatggctcttgcaaagtggcacttacacacagatcggcaattatggacccaggccagcagtcacaaacaccactgcaggtgctggctcactacccccacatccctcatgcaatcagtgctaacagtttcatggaaattcccattaatgttttaaagcactggcattcagtaagaatgtgcaggtacagcaattaccaatgaggaaaattaagtctcattttcaaagattagcacatgttctacaaattgaatgttatcccaagaaatggaatccatggaatgacctgagaatcaatacaatttcttttttatttttacagaagtagtacttttcttgctatttaaaaaataatttaaaattttttaaaaaaacattctaagtgttagaaaaacctgttacgtaaatgaaccctcagaggaatggcattaattaagagagtagagcaacacggtgtgagcctccaaactcccacattctttgttcatcttcaatagccaatataattagttttgtataaatattttatttacatataatatttcctatcttcactgctaacataaaataaacctcttacaaatttcgatgctttaagcatcttatttcacctgtaacaaataagacaaaacattcaatgttaaaaaatttggatcatttctagtattgatttccaaaagcttttggtggtgattgagattcataaaatctctactacctcttaaaagaggagaagacatatttttctctagtaacatactgataagttagaaacacatggtgatgtcatcatgctggggggaaaacatagattatttttttcctttaatcaagactgataagactatgaattacatattgttctaaaagtctgcactggaataactccagctgaaacactcttcactggtactgtgggaccatgaaagtctttctatatcatgagtatctcagtcaaaaggtttccaggaatccatctaagacctcactcaggggccgcctctctcctaccctaaacactccttgctgtaagttcccttcaagttgaatgtctgtagcaggctgagctatcccatcttctgcagtgacttcacctgtttaagtcagcaatcccccgagatttgaagcttctcaagggcaagtttcatgtcagtggtctcacttctattccccacccccaccttcaaccaaaaagaatgttgtcccaggaagacattaaaccctgtgaatgatcaagtaattaagaaattggtgagattaagaaagctcgcttaaactcaacattttaaaaacacaggaaagttgctcggcctgtgctacagattacagtaatgtttctgtttacttttgatattgtctctgcctaaagaagaaaaacatcgggctttgagaatgctgcagagtcacaggccggcatgtattcttcattgcctctataaaaggtaaacttagagaaatctaaacatgcttatatacagtcaggcattgtttaacaacagggatatattctgagaaatgtgtccttagacgattgtggaattgtgcaaacatcagagtgtacttacacacacctagatggcatcacctagtacacagctgggccctatggtacagcctattgctcctaggctatgaacctgtagagcatgttactgtactgaatactgcaggcagtaactgtaacagtaactgtaacacaatggtaagtatttgtatacctaaacatatctaaacatagaaaaggtaatgtgacattatgagggctatgatatgactgggtgatagaaactttttagctcaattaaaatcttatggggccattgttatatatgtggtccatccttgactgtatgtctttatgtggtgcatgactatattagcagtcaataggaaaaaaaatgaagatataaattgataatttatcagtcagtatctagctttctaaatgtactttaatcttgtctgcaaaaaggattgggttgtttgggaaaagggagaatgatggttagaaagtggggtggtggtcctaaagaaacagaagaatattaaaaacctatcaagatgccatctatcaataatgttaacaataaatattgggggaaatctcatggactcaacactagtagtttgtgagaaaataatgaaacaatcaagacaagcctccctttaacagttttcaaatcctagaataacactgagatgtattccgaaacaccgtgaagggtatttcacaatgcatacacaactgggaaggagcctagcatgctcacaatagtaaaacgatgctgggcacagtggctcatgcctgtcatcccagcagtttgggaggctgagacaagttgagcttgagctcaggagttcgagatcagcctgggcagcacagtgagacttcatctctacaaaaaataaacaaaaaaatagctgaatatggtggcacatgcctgtacctccagctaggaatagctaggaggctgaggtgggagaattgcttgagcctgggaggtcaaggctgcagtgagctaacatggtgtcactgcacttcagcctgggctacagaatgacaccctgccttaaaaaaataaaaaaaatgtatattttgtagaattattactatagtaaaaatatttccaaaaaaaaaccatacacacacacacacacacacacacacacacacacacacacacacacacacacacatatgaatagtaagaagtaatagagtcttatattgaaagttctttgatgtcctattctggaattattctagcttcactttcccatgatcctgtgttctatccagatgcatccactcatacccttaggaggccagaaggcagccatgcaccctagatcaaaaggtgttggctcaatgctgttagggagtgaccccagacacatcccctatctctctggagcttggttcaggtctcagacgtacagcatacacacacgaacaccaaggtgccaggagacactgcaggaagaccttcaaaggggaacagatcaaacaaataggcacctgaaggaagggaagggaagtttagaggtggggccaattcaacacccagagttctatgacttccaattgcacgcactttgtttcagctgtaccatcttttctatctccagtatcctaggttttgagcagcagaatcgtggtttccctagagagtcaagacagaaaccacagcacagactgcctcctctcctttcttcagggttggatggttctctctgtgtagttggggatggcagccactggttacctgtggctctgagcacatgaaaggtggttcctgaaactaaggaattcatttttaaatcttatttacatttgtttaatttaaatttaaacagccagttctgtccagtggttatccaaatttgggcaacacaggtctaagggaatgaattccttcttaacacagattgaaggttccagggaagttacctgtatatttgcagacttttatccagtacatatgcaaataatttctgtccagtgaaacagataacacccaaaatgtgtggcctggcggaaatttcttagttgataaatagatagatagaaagatagatccctaatttctcaaggctctctgaattggtcatggtatcttatgatgtccctcattcattaaaagattaaataaaaatttttacatgtgttcactttatatttgctttataattttaccttttgtaaattatactttaggatcttatttttgaggagagagaagattgttaaggctccagcttggagttgtctctcaataagtaagcaataaatattcacctttcttcctcatcctttatccctgctaacagcatctaggaatccttatttcatcctacttccccatctgcaaccttattgggcccagaaataccacttcctctaggaagtcttacttaattcctccatttaatgtaaatcccctccccctaaatgcccactacatttgagttgcatcattcttaggggtcgtaagctacattctatctcacaatatcccatagataattttatctctcctaccaggctttagattcttttgaaggtgaaggctacattttattgcattctccctggtgttgatgaataaaaacggtaaatattatgtggaggaaccaaataactagacttgaaactaatggtgtggtataaaaaagtctttcagcttgcaaaagataaaatcacaatcaactggccttaaaataacttaatctctgtgacaatataatgaggaatgttcttccaggcccattaaaatgacatgcaatttgataattatttttacagtgtcaggattctaaactaaatgtttctcagcttctgttatctggtgatactaaatgaatgttgtcaaaagattaaatgtaaattggttataaatcttcatttaaccacatcatgcagggaaggttacattacagccaccatgttcgtgtcatcattaagaaatggagtcttattttaatagtattaagactattgaaattattgtttattctatctaattggctttggagttgaggatgaagcttttgatgggcatcactgaatacaggagcaaaactgaaataaaaatgaggggcaggccgggcggtggctcacacctgtgataccagcactttgggagggcaaggtgggtggatcatgaggtcaggagttcaagactagcttggccaacatggtgaaaccccatctctactaaaaatacaaaaattagctggcatggtggtgcatgcctgtaatcccagctacttgggagactgaggcaggagaattgcttgaaccgggacccgggaggcagaggtagcagtgagcaagatcgcaccactgcactccagcctgcgctacacagtgagactctgtcacaagaaaactgaagggcaatgaacttaaacccttctggaccccaaatggacaaatggacaggatggggaatagctgcagccactatctgcaggaaacactatcattgtctgaaaggccatcttcactttctaactagattttccaaactaattaaacaatctaatttcagtgaaaagtccttcttttaaaaacccagtttgcggccgggcgcggtggctcacgcctgtaatcccagcactttgggaggccgaggcgggtggatcatgaggtcaggagatcgagatcatcctggctaacaaggtgaaaccccgtctctactaaaaatacaaaaaattagccgggcgcggtggcgggcgcctgtagtcccagctactccggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaacccagtttgcctggctttttcaggaaatgacctatggtttgatcacctgtccaaaccatctggcggcaggaatgtgatctagttagactctcacagacggtgtctgggaagctccatcattgggctttaatgttaaagccacacggccacacagccaggacactttgatgaacagccactcacggacacagtgagcccatcatgagatgatgagaccaagttgcattacaatgattttgacagccagcaaaattatatttaaaaatgaaatctttcttttggttctgtatttgaagtaaggaaaatcactttgggggtaaaatcagggttttggaagaaactgatacttcttattaggtttaatttaactggcagtaataattaggacatgataattataccaggtgaagcctgcaatagacttagttctactttaatacttaattgatattgcaaacaccaagattttcggtgtacagacaaatatagtatccttgtataaatgtatatgctcaactaatgcagctattctacaatcgaagaatctctccttaatcaaggaaaatgattcatatcagaaaaactgtaaaaagcacctcttgacacattctccatgtgctacatgaaccaaggcccaatcatttgttcccctcagtctctctcctgatatgcatggtttccacatccctttctacagcctctgtgtgggggtaggaagaaggaagcagaaaaacaaacacacacatccacatgttccttctccttactgctctggcttctcagacttggtcccactacttacatttttttgtttgtttatttgtctgtttgtttgagacacagtctccctctgttgcccagcctggagtgcaatggtgctacctcagctcactgcaacccccacctcccggattcaagctattctcctgactctgcctccctcccaagtagctgggattacaggcgtgtgccaccacacccagctaattttttgtgtgtgtatttttagtagagatggggtttcaccatgttggtcaggctggtttcgaactcctgacctcaagtgatctgcccacctcgccctcccaaagttctaggattacaggcatgagccaccatgcccagttttaaatttttaaaagagtattaataaatacatcaatcagaggaatatgtaagattctactgagaagcacaattcctattagcgcaagggagacaaaaacactatcatggtattgttaaggctccagcttggggttgtctctcaataagtaagcaatattcacctttcttccctatcctttatccctgctaacagcatctaggaatccttaatctatccgacttctaagtaggaggtgagcaggggtgtgggaaaacattctggcaggatctctatgcaaaagaaacaggtggtttagggtgcgattgagaggtagacatgtcccacacagctccagcacagaactgcacgccggggtgacaggtctgcctttcagaggactaagctgctgtggcaacagccagccacagccctccagaggaaggaccacagttcataaactttagagtctctgggagcacttgctggggagcagcgtgatggaggtgctttccagaaggcggtgctgaccaggccgctccctgcggaagcccctctggggaaggacactgggcagcaggaatgatggtggtggctcagcaggggtggagaactcctgtgtgcagcctgtgttcctgctgagagaggccccaagccctggagtcatgacatcaggaggctgtcgtgactcgttcactaggtgtgggaagcccagcactgtgtagtacatgctgcagagggcagaaccctgaggtgtgtggcagcctagagtcctgctgagcatggcagccggggctggaaacagtgaggcctgttctggagtgcctctgtgcaaatccacctatctggggttggggattggacatgagttatttattcgtttattagttattaatttttaagtttaccagggaaattgcatgcatagcaaaatatggaaaccattcattaaaagattcatgagactaaggtatcagttcagtggacacaaaataagcattccaggagtagaaagcaccctactttgtggggtgacattgagacagtgctgggaacctaacagtgaagctccctatgtgaggacctggtgccacaaatggggtggtagataatgcacatgggcctccactcatgttcctccgtggcagcgaattaaagaacatccatcttcttacttcttttctgtttctcagttgccaaccatatgcctgtttagttacacacctcggcatggtggctcacacctgtgatcccagcactttgagaggccaagaaaggtggatcacttgagcccaggagtttgagaccagcccgggcaacatggagaaaccctgtctctacctacataaaaaataaaaattaataaataaattagctggtcatggtggcatgcacctgtactcccagctacttggcaggctgaggtgggagaaatcacttgaacccagtaggtcaaggctacggtgagccatgatcctgccactgtactccagcctgggtaacagagagagttcttgcccaaataaataactaaataaataaaataagaaatcagccaaagacttcacttgctctgacagaaactttcacaaaatctactagaacgcagtggattcagagatctgtcaaacacttctttatctaatactgcataggtgactccctgtctagaaaaattaataaaaactgacaagccacctgcactgtagctcttccgcttcctctactgttcattattggctttatttcatttctatattaaactgcatattacaaactcaggccagctggatctttgcatagatactatatcttgtttctgccagagatgatttttattcagaatgaacagtaaaaggcaacactacgtagaaaatgcacttgagttttaaaataaagatgaaaaaacttgtgcatcatccaatggtcctccgcagcatggaggaaaaaaaaaaaaacatacttcagggagataatatctttccttctccatttcacaaatgggtatcttcaattaaaacacttgtttagattcattagtgtttccttgatttgattcttcggtccatgagtaaatacattttagagattaaatgattagtttctttacatatgaaatagggctaatagtatttgcctttaatgatgttggagaatagtaaataaaataaaatacccttgccaggcatgtacagttgctcccttgtatacataaaggattggctccaagacctcctatggacagcaaaatccaacagtgctcaacacctttatataacatggtgtggtatttgcctataatctgtgtatatcctctcatatattaaaattgtttcatcagcaatggggaaaagactccctattcaataaatggtgctgggataacaggctatagatatacagaagaatgaaattcaagatggattaaagacaatccatcttggagttcatttttctgtatggtgattcctatacagaaaaatacctatcaccatacagaaaaatcaactcaagatggattaaagacttaatgtaagacttcaaactataaaaatcctagaagaaaacctagaaaatatccttcccattctaggccttggtaaagaatgtatgcttaagtcttcaaaaggaattgcaacaaaagcaaaaattgacaagagggacctaattaaacctgcataattaaagagcttcggcatagcaaaagaaacaaacaagggagtaaacaggcaactacagtctggaatcttcaggaatgagcccagcaaggccagagttcatgggggaaaaattttcaacataaacgtaaaagagtgactaaatcaatcaagggtaagaagtgaagattcaagtacaaagcagagggcagcaaaccaggtacaaaggaatctgtcacctatgcagtgagcataacccaacaggtagtttctcaaatcagagacccaaccagtaaccaaggtaaaagagggactaaatcaatcaacgaaaaaaaagtcaagatgcaagttcaaggcagaggtcaggaaacggaactccacatggacacagaatggtctactcatggcgcagccaaggggaggggcaggcagccgtcagggaaaagtactcaaaaaggcaacacttaccgaatgactgaaatttggagtcatggatttcagcagggatttgcagtgaaagaaacaggcatatagagactaagttcccaataaacgttacaattcatcctttcactctcctcttgaaatgggatgtattgtgaatgtattgagctaaattatcctgcatggctttggccagctatcccattctctggtgagtgtttattttcaaagagttagatgagtgaagagcggagaatggtaatgtaaccaatctgatgccttgttagaaaatcttccctcatgataccagaatgctttggtgtgaaagactggttcctgctggaatagtttcttttttaagactaatgcacaaaaatgcatattctgcctatgtttcttcccatgatgtgtattcatttagtgcgtaaggaattatttcttttcttccttgttcgcctcagtcctagtgcccagctcagtatcttgcatttgctgctagttgatgacactgaatttgcagcaaaatgaaatagaccttcttcaattggtctggtctgtttgtcactgagtatatgtgtcattgctgtgacagtaacctggctgatgaatgaaatttactggactatgaacagtaataagatattcctgaagccctggtttctcactttgctatcttaaaccaaagctattaaactcttcaaataagcatgctttattcagtaattcatagacttcaattaaatttggagcagcagagaactctgaacattcccattgatgccacagtggtatggccagagctaggctcaactgctccaaaatcgtcagccaaatacctcagtctcccaagccaaaatttgacatagactatgcttctccggccttatttcattactcaaaataagatgattgaaaaatgtatgaagcttacagtagaatactagtgggcacaagagaggagatgtaaatattcaggtaaaactcaataagttcagaaaaagattttcagcagatgcaaattaattggaaaaaatgtcagatgataaatctttgctttaccactttgcagtctgggtttgacaaggacataatctctaaaaaggaaggattttcaaaagaatcaacagaacattaaaggtatagagaattcagacactaattcaatcatacataatcttatctaacagttaatacactttctaagatgacgtaccagttggaggataagatgcaaaggatgaaaaagataaaagtagatttaatgcaatgttttacaggtaaaacattggttttggtttgaataacgaccttttactcttaccactttggacaacataggaggcagaattctatgataatccccaaaattccagccccctaatatacatgtcctatgtaagtaaccctctcgccttgagtgcaggtggcacctgtaaaaatgatcagatatcctcctattaggaggttatattaaataccaaagataaaggatttttgtagatgtgcaaaaggtcagaaatcggttgattttgaattaatccaaaaggagataccctgggtcggcctgacccaatcagagaagctcccatagaaaaacagtccagatcttgtggaaacgaagatacggagatagagcttccgaccgctttgaagatgtgaactatcatgctgagagtcccacgtgtcagggcattgcaggagcctcaaggagctgaaagcaaccatggctgacagccagcaagaaagctaggacttcagtcctacaacttcagggaatgaattctgccaacaatcatgtcagtgtgaaaaatgaatcccaaactgcagaaaggaacatggcccaattaatgcgttgatccatccttgtgagaccctgagtggaggatgcagttaagcactgctcacaatgtctgcgggtcagacctgaggaaatgcgggacctgactcacagaaattgtgagatcataaatgggtgtcgtttaaagccactgcactagtagtaatttattacacagcaaaaaatgactaatacgtgtggctggtttacttcacctcactgttagttttcttttttttaattttattttattattattatactttaagttttagggtacatgtgcacaatgtgcaggttagttacatatgtcatatgtatacatgtgccatgctggtgtgctgcacccattaactcatcatttagcattaggtatttctcctaatgctatccctcccccctccccccaccgcacaatagtccccagagtgtgatgttccccttcctgcgtccatgtgatctcattgttcaattcccacctatgagtgagaacatgcggtgtttggttttttgtccttgcgatagtttactgagaatgatgatttccaatttcatacatgtccctacaaaggacatgaactcatcattttttatggctgcacagtattccatggtgtatatgtgccacattttcttaatccagtctatcattgttggacatttgggttggttccaagtctttgatattgtgaatagaagaccataataggagggcactttaagaatttcatgtgattgacactcttggcatgtagctagcatgtaataaaagctcagtagaggcagttaatcataataatagtgctgctaatagcactattagtagcagcagtataaactgcagtaattgtgacaggctggaactcctagatatgcttgtaaacaaaattaaattgggatgaagaattctacaggctggtatttgactaaattaaatcaatgcttgattaaatctattgacatctatacgtatgtgtatattggcttattccaaatagacacgtgacacacacacacacacacacacacacacacacacacacacacacacacaaacataatgctccagaaacagcacagtatacctttctacaaatacactacacattttcctacctttgtatctctttcttatgtcctggtttttccccctgaaatgtcattcccacagctctacctgtaaaatttgttgacttttcattgcctacctaggatattgtgtattaacaatgttccaagagctgttgttgtcgttttgtaatatgagataggaatcatatgagataaatattactattattccaatgtatccctttttaaaggacagggaatgaaggactacaaagactgatttggctgtgttcgtggtgtggtgtcagcatctgaaattagtcactcaagctcctggttgtgccttccaccaccacaataagctttgagtcgatggcccctcatagatactcctccataccccaaaaagatttttttttccttttcttatctcttaacgatattttatttgacttagtagggtttaagctaagaccaagctgagctatatttggcatatagatacactgagtttacagaactgcctaacaatgttctggtcaacaatggactgcatatacagtggtagttttataacattacaatacggtatttttactgtactttttctatgtttagatacacaaaaacttgccaatgtcttataatttcctgtagtattcagtccattcacgtgctgtacaggtttgcagcctaagagcaacagctgtaccatgtagcctaggtgtgtgcgaggctataccatgcaggtctgtgtaagtccactccatgatgttcacacaatgccaagatcacctaacggtggactactcagaatgcatccccctcaaaaagtgacccaagactgaatttacatccactaatgtgcatgtggggaaggacaagttggagaaaaagcttgatgcgtgccgtcatttatactttcccagttggaggagagaagccaatcaaagggaattaacagagaggctgcaggccttctggaaggaatctatcttgagggaagtaggcctggggaattggatgctgctgcatcctctttctgggcacggacccaccctgacccagccactctagtattatacgccctagggagaaaatcatggcaaaaaattaaggttgttgctgcaatccccagggcccaagccatcttgctctgagctgctataagagttttacacagtgcaaagccattttctgatcaaattttataaaaaaccatactcatctgagatgccctgggttagtggtacccgaaactcctggtgttcttgggagagacaggcctgttgtcttggttcattttctgtggttataacagtatacctgagactgggtaatttatcaagaaaacatttatgtagctcacagttcttgaggctgggaagtccaagattgggcagccctgtctgggctgcatcataacatggtagacagcaacacgtggtgagagcacatctatgagtgagcaggtgcaaaagacaaaacacaaagagtgaccgaactttataacaacctgctctcatagtaactaatacagtccctcaaaagtaagaacccactcttgtcagatggcattaatccatccatgactgtaaataccttatgacccaagcacctcccgaagttcccaccacctttaaaccaacacacctacattggtgaccaagactcaacaggagcttctgtgagaagaaaccatattcaaaccatagcacctgttgaacttgagaaattcaggcttacatgttattgtggtctatttttaaagctgagagatcgggataccttctttcatctctttggtatcttcagaagtttgaaaagtatttctaagttaatctaaccttctttttcatactaacctgacactgatgtggccaaagagacctggagaacctgagatctctgctgtgcacatctccccaacactatgcaccttggagctcctcatctctgcaccctccatggagccaactccaatgctgtacacacagcagaggcttaataaatgtgctttgaccaaagattttgttgtatcaacccacagtaacaaaattgacagtagatgtagctgatgtgtttaacttcagaaaacatatatggggaaatctcatataaaaggacaatgtggatttacctgggaaatagttattaactaatgtaaactgctggctacagaaaatgactgctgttaatgtagggctgtatatatatatatatatatacttttgttatatatttatacttctattattttattattttatttcctaaacatatatgtttaggaaaccatatgtatatacaaatggaaagagttggaagcaatgatcccccaggggaatctattgcatacaggtagggagaaggcatcaataagtttaataataataataataataataataataataataaaattagatcaaactgggcaggttagaaagaacttaaggagaaagagtcagtgcttaccctaagaaagaaaagactcataaaaaaagagagactgagaaaagcagaaaaataagaatcagggctatgcgctttgagacagacaggcagacaagacagaggcagagacagatacagagagagagagagagacacgcaggcaccagaaaggagagagtgctcccctccaaggctgcgctgcaccccttcctgggtgctgtggataggggccctagggctcctccttccacaatggcactgtaatgggaaaggcccacaacaagcatgaaaccagtcctcacgagcagagccatgtgggtcaaattactgcaatttgggagaaattctgcaaagacatttgggagggatttgtgcaggaggaacaccaagaattttgtttgtttgtttgtttgtttgtagagagagccttgctctgttgccaggctggagtgcagtgctgcaatcttggcttactgcaatctccgcctcctgggttcaagcgattctcctgtcccagcctcccgagtagctgggactacaggcgcctgctaccacgcccagctattttttgtatttttagtagagacggggtttcaccgtgttggtcaggctgatctcaatcttttgaagtcgtgaactgcccgaagactccatgagtataacaagattaacttgagcctaagaattcctaggcatgggcagctcgctgcttcagccactggctcaggccaaatcagttcttcaaaatcagtcatggctccagtcccctccttggtatatgctgctacttatgaggaaatcctaatcctgagcacagaagttcattctcttgctgcgctaatgatccggccagaaagtgctgacagccggctggctgcctggctggctctcctgcaaatgcacagtcttcttgtcatacagcaggaggagcacaatggataaccagtgtatatatctacatttaactttacgtaactatcctagtatacgtatgggacttgcatacagtcttccgcatatgtacatctttacgtagttggtatgatttctctgtaataaagtccaaattttagtgtgtgtgttaattctcttaacatccacaccctttactcattgactattgcattcatttttagctatgcaacactttgaaaataagggtttttttcccccaccttaatgtaataaaccaaaccactgcaaattttatcttgcttttcattatctggaataatttagctactttttttttctctctctaccctttatatctatatccattagaacacagttcctgaaaatcatggtttttgaaaacccaaaacatatccaattatagtttaaatgtaagagactctctcaatgatcaataaatctgacacccacaaacacttgttttactttagaaatggcgcaaatatgtgagtcccaaattatgaaattatggtgttgattttcactttgtgcttgacctctacctgaaggtacaaagctgaggtctaatttgacattaattaatcttactctcttcccctcactcttaaacttgaaaaacatagtagggaaaaatgcactagccttctaccattcttatgccctatgtgacataaaaacaaaagtgaagttagctacttagtcaaagctggcaaatgcattctcaccatccctagtgtccatacagaaaacgtgcatgccttctggacagaaaacactaaggttgtgttcctctattgaaatttgggggaagtccaaaaagatggacaaaggatgttgtattttaaaaaccagtagttccattaaaaaaaaaaaaaaaacttaactacttagtgacctgagtgacatcaatgtgttcttgtgagggctattttctcatgtttggtggtgaatgtgcagacacaatgtttatcgtagagagaattctccaaatagaaggtgtagaaacctcactacgctgagctcattcaaggacctgggcataaagcaaattacaagagggattgaaccacgtaataagagagaagcctttagtctttatttctactgaagcaggtatgctttagagagacgtgtttcaactgaaatgcacaaaccacaaaatcactaaattcaaaattcaaaagagaaattcatcataagggctgtggaattgacttcttagagtatattttgtggaaaatagaaatctggagcactacattttagatgcaaagcataagtgggtccccgatgttacagttggtcaaccacacgtacagacagggactagagactcttctctccaccttcaaaaatgacaaatattggtaatgagagtcccagaactaatcctttcctgtataaatgtgaatgctcatttaaaatttgaaaaataaagttatgattcattaaaatgaaaaacaagaaatttaggggaaaaagttcttagtccattgatcactcatctcactttgctgaaagatcgttaaatggtttgaaattaatgtctgataaatatgtgagctgattgaagttataaatatcttcaaacagctattcaaagcttattaaaaatcttcactttaatgaggcgaaaacatgaaaattgactctacctaatgcctagcagagtccaatattgcactttacatattggtttacaaacattatttccaggtgtctttaaatagagctccaatcttgcactgttctgatttttcaaaatccttccagatatttggactcaagtaccatcactaagaatagaacccacagtaacatcagcctagccacaagcttccacatgcaccaccagtagctgctgctttgcggtgttgtatgctggatcttttgtacacctctaaatgatggaaggtaccacagcgcaatctatgggaccacttctgttttctatccaaactcgctgctcaagtgatcttctcagtcctatggcttacgtatctaccctttgctttttgctaaatttatgtttccagctttgagctgcagatttgtacagcaaattgtctccctgactcatctgccttgccatctctaaattactatgcccaaattagaatccctgattgttcttcaacaaaacctgcttctgcctagtctcccccatcccaacaaaaacacccccagtcacccaggtgttcaagtaactgtgattcatccttaatttctctatttccatcatattcagcttctaatccatcaacagatactgtaggttttatcatcaagatcactccagaatgagaccacctctcaccaccttcagaatgacacaagcgtcacccacgcaagcacctgctcttacctggaatccattacctgcatccatttcagcctgcctgagccatttctccaacagaggctgggcttttcttttagaaacatgaattagagcccattattcctttgctcagcacctgctgatggctacctatgcatattctttacacacatctgcccctgcccctctcccagatcaccagttcattcccagatccagccactctacatctacatacaccaaactcaatatctgccctcggccttggcacttgccattccctcttcctttccactgttcctctcaacattgcacagctagttccctcaatctatccagcactcgacttagagaagcctttcagaaatagtctgtttttgtacaaacgaccaatacctgtatcctttcgatctgtttgacatttctgtatggactcataactagctcaaattatatagcaaattaatttaattacttgcttactggccatctttcccactataaggtcagctccatgaggctaggaatcctgcctgttgttttcaccattacatctgagtacttagaaccactccgccacagagcctgcactccgtaaactttcctttattgaaggaaacataattgaatgtgcatcccttttcacagcctgggtaccagacaattcttatattctattattgtaaaggtaaactgaagtgcaaataaacataactttgaatagcaaggttgtaggttgaaatcaagtagtcattacatatgtatatatgcatgagcatatcttactgaagcaatttttatattattggcctatatggagccagtgaatactcaaattaactgtaagtgtgtctatctgttggcatgagccaagaagtatgacaacagtgacggttcacagagcaggatgtagctggctgcatttgctgtataccaagccagctccttggctagaagcaagtgggaagaagcacaccctctttgaaataatcctgcaagaggcaagctgggcttgaagtctgggaggatccaggggaagagtgaagaggaaggcactcagctgataaccaacttcctcacttgctccacttatatttagtgattgctctgatcacaatttgaataatgctcaccagagactgttagtcagaacaatgtgtcccctaggactgatctactgacttcaatttcatgttctaatacagaacagcatacataacttgaagataggaatctacacaactgtgaacaatagaggagggtcacagaaatctaataacagcctggagagaatcccattcttgctttgctgtcatgccaatgaattgcattctacaagaaactctgttaattgactgctcctatcttgcaccaggcaaaccaagtcacagtgaagagaaggtatccatggctctttaaagcagtactttataaaaattctatgcatgcccatctgaaaataacttaaaatctctgttgtagctttctgatcttctttctatctcataaaaaatatttcaaagtaacatcgtgggttcagacacctgtctccccaatgtgatgtaaattcattggactgatggttcctgtacgacaaatgctggaggtgctgaaggcattccatagatagcttatcagctttctcagaaattaagaggaaattcgctcctcactggaaacctcagataaatatgcctccctctctctctccttttcctttctccctctccttctctctctcctctaaactcagttagtttccaaagaaaatatttcagagagctgagagatcctccctaatacagaagccaaccctcctgatcaccctccatgtaaactgaaatactaacatttctcaatgtttataaagaaaatttactttctgaaagggaaaaccaaatttattgtcccagtgttataaatagtgtttgtaattacaaattgatttcagagaatgtgaagttcagttatgcctaaatagataagcatactttttaaatgggtaagaagtcattgggaaaaaatttaacagtggtgttccctaactccccaaaatctcttcagatgaggaactgcattttatttatactgagaactgcaacaaagtgataaggtgtgagagggaatcctggaaagacagagcagacagtatcagctgcctgctggatctgtatctaggacagtgaaatatcacaatttgatcatttgggaaaataacagccatacacatagcacggtcctaggaaaatcatacttgtgtggtaatcccattcaataggttaataccgaatatgctgaggttttggtattgtgaaattagagagttacctattcattcccaaatcaggaagcctaatttaaccacctgatccgctgtcccaaatgattaactacatcccagagagagaaaaatatatatgaattaaacaaggcaatctctcccagagaagacagaaggaaaactaaggaaatgcagtgctctgtaatttctctggccccacctcactaataagggcctggctgggttaaggctgctgtgtccacagtatcatagtgtcatcacctgtcacctagagatgggggtctgtcactgtgaccacttccataccccttaacctctcagggaggttaatttcacagcccttggaaagccaatttctaacatagtgtcagaataaggtatcactttcccagaacagggagagaggctttatctcaagattatgcgaaacgaggggtatgtagggtatgagcagccacatagggatttggctagcctgacaatttctgcatctcctgactcctattttctgagcctagctcacggcactgttgctgacctgcagtgcctgttgaaggctatgtgctcagggcctttgcagctcccctcccatgcctggctactgtccccttcttctgcaggggctgccttcctttcctttgcaggggtaaaaggatgatgaccaggagaaaggcgacctttcctcctcactccccaactcctgggggttcatccccatcttcctcactaaatatagctcagtttatcaaatggccagttgaatgtcagggaaaatggacccttttcctcagaagtggtggattaattgcttttcctttcacttttctgaggataggcatataatggagcagccgcttggtatgaaatcattgatttgcctcaaggttgagattaagccagtcacttcaaacattttaatattagcaaaaggctttgtgtgattttttcttctctctgctgtgactttattcaaggtctttagatcacaggggctttgacaagtttgtcagtgatcaggggctgccttaatcaagtaagaaaaaaaatcccgccaagacctcctatgcatttatatgttacaggactgtttaatgccagtatctgcacaaagcgtggtgtgtaaactacaggctttagaggatattaattaatacagattggagaatttctgatgcagctcattaacagagatcaatatttaaaacttatgtttgggtaaaaaaaaaagtcatggtaaataattgagtaaaagaggaaatacacaccagcataaaagtgtgtttatttattttgcacaaatatcaccatgagcactaatgaacaactatatttccttacagtaaaataataccacatggagacttctaaaagaaacccattgatagagtcctatagtcacccttgtgtacaaaaagtcatgtgaatactgcaaaaagaggcacatcttgtcatttcaatattaactctccaagaggtttttaaaacatctccaatatctatatgtaaaggttattcattaatattggctattatttggatgtgaatcctagaaaaaatatagacatttttaaagcaaagcatatgcaagtatttctatatgatacattaaggaatgtattgactgaaaatacaccaagataatgcatatctcgtaattcagattgaaggaacttattctaaggaaatgctatacaaatatgcacatacaagatgttcactgatgcagtgtcacaaatgcaaaaacctggattaaaaactaatagcctcagttatgttaatggaaagtgaaatactgtgaagccattaaaatgactctaatatctgaggagaaaaaacctcctcctcattttatagacaaagatggtcaattaaaaaataattaacgaaaaaattttccacttttggggaagccattttattgaatacactcacttatttaaacattcaagaaatactggacgtgtccgccagatttcatgtggttagaaacttcatccccaagctcatatattaattttaagtggggcatttgggaggtaactaggattagatgaggtcatcgcagaggggacaccctgataggactggtggtttcataggaagagaaggagatacgaatggacatgcatgctcttgtcctctaaccatgtgaggcagcaagaaggccctcaccagatgccggtggcatgctcttggactttccagcttctagaagcatgagcccaataaacttattttattaacagattatccagactgtggtattctattatagcaacagaaaatggactaagacatatactgaagagttgatgacaaaaataaatatgtgattttgacacattctatgaggaaaagaaaaagatgcagctcagaatcatagtattgaacctaacataggatgggggaaaaaagcagagaatgtgttgttaggatactatgggaaagtgagaacaggtacacgacaatttgcaactaagaatgttttggactcagagggagaatgcccctggcatcatgtcaaggctgggccacactgagttggggcagaggtggggagacagaactgaggaaaagtggagccaggccccagtgagctggctttaggattctgaattttgatttatttcagttcagtttatatactaaaaggtttgattcagttggttcattgaaaagatttaccagggaagaaatgacacaagtcatatgttttaatttagttatataacataatatagagttgtccctgaggatctgaggagggttggttccaggatgcccatggatacgacggtctgcagacactcaagtccttgatataaaatgacagagtatttgcatatagcctacacacatcctactgtatactttaaatcatctctagatgacttgtaatacctatgacaaggtaagagctgtgctaatacttttcatatttattttaaaatttgcattatgttttatatttattgttattttttactgcttttccaccaagtattttttatggattggttgaatctgcagatgcagaaccaagaatagagggcagactgtggtgacagacaccgtctgtgttatcacttgaagagctgtcctgtgggagaaatgacagcatgacaaacaggctatgtggacttcagcacatcggcacaatgtgcctccagttttttcatctggaaaaacaactggcagtgggtggtaagtgatattaatgtcccttccagttccaagtgcagtttagtgctttgggaatagtattcagagattctcttatggcagtgacatttttaccagtgttaggtgaataaaatataactttatgaaaaaaatggtataaaaggattagtatgttatttttcttatacaaaggaaactagctgaatgagaggcttaagggatatttgtcttttattatgtgaggtttttttgaaatttaaaatatgaagaaccaaaacttaccactaaatcctactgtccagattgcttttaaaagttctactgtgagaggtaaactgggaatctgagtgtgtttccagttgtgtaataattacattgccttattgttttttagccaggtaatattcttatctggaggcgatgtttaatattgtttgaatatctatgtgacttgcagcactatcataaatgagtcttacgacatgcctccgtcattctgatattgtggacaaatgatgttatagctatctacgaacattacatataaagaatgcatattgtcaagattgaattttacctgaggtctgagcccctggaaaacaatgaaaattaaagaaatactcctcatggccgggcgcagtggctgaagcctctaatcccagcactttgggaggccaaggcaggtggatcatgaggtcaggagttcgagactagcctggccaacatggcgaaaccctgtctctactaaaaaaatacaaaaactagcgcggtggctggtgcctgtaatcccagctactcggaaggctgaggcaggagaactgcttgaagccgggaggtggaggttgcagggagccgagattgcaccattgcactctagcctgggtgacagagcaagactctgtctcaaagaaagaaagaaagaaagagagagagagggagggaggaaaggagggaggaaagaaagaaaaagacggaaagaaagagagagaaagaaagaaagaaggaaaggaaggaaggaaggaaggaaggaaggaaggaaggaaggaaggaaggaagaaaggaagaaagaaagaaagaaagaaagaaagaaagaaagaaagaaagaaagaaagaaagaaagaaagaaactcctcacccttcagtgtgatcaaaaacagcttactgccaggtccccctttccccatatgaattagatgtgtcacctaacactggtaaaaatgtaactgctataagtgaatctctgaataatattctcaaagcactaaactgcacttggaactggaagggacattaatatcacttgtacccgttgactacataggacaaggccagacttccaattcctatcctttgcctcaacaatgattagctggattgcttgtccctactgatgaatcagaaatgcttattggttaaatttggtgaaggttctctctatcctcagaaccctgacctcaaccccagccagcagagagcctctcctgagaagaagctggccctagggtaaaaccctctctcatttactatcccatatgtctttcttccaccccactcctccacaccagttcttactagcttgtttattcccctgtataaaagaaagcccaagcttggtgtggtggctcacgcctgtatcctagcactttgggaggccgagatgggccgatcactggaggtcaggagtttgaaaccagcctggccaacatggtgaaactccatctctactaaaaatacaaaaaaaaaaaaaattaactgggcatgatggcacatgactgtaatcccagctactcaggaggctaaggcaggagcatcgcttgaacctgggacgcagaggttgcagtgagccgagattgcaccattgcactccgcctgggtgacaagagagaaactccatttcgaaaaaagaaagaaagagagagagagggacagagagagagagaaagaaaggagaggaaggaaggaaagagagagaaagaatgggagagagagagagagaaggagggaaggaaggaaggaaggagagagaaagaagaaagaaaagaaaagaaaagaaaagccccttttgcctaacccttgagatgcctgcagatcttatggtcagagcattcttctattgcacccatcctcctcccactattcgaatagcccatccctaagcccctgcaataatcctttctaataacgtctactcttactaaattgagatttattttttatttgacagggtttttaatgagaaatgctttttacgaggttagaatagttctggtggttgttccttagtctctcatcacatctcctttatgacttggaaagataaatttagcatggaaaaaaatgtgattattagaaaacaaaaagaattttaaatcatgaaagaaatttatgcaaacaatagggcaagacctagtacataaaaagagtcagtgaagcgaataaaaacaacaacaaaacagcaccaccaccaccacttaaccacaaagtgaaacaatttacataatgatttcttgcttttcttcttcatattattgaaagtttctttgttcatgttatctccagtggtctgttaaatgtttgcaatgcctcagtgctcctctgaacaactttgttaggaatgagaagtgctctacctatcaacaacaaaggcagccgaatggctagaaataagtttgttgaaaatacttcttgggttctgccttacctgtcaatcacaaaaagaaggtggagaaaggaggcatgcttatggcatcccagttttaaggaagaacattttagcaataagcaagcagtcaccaaaaggattcaaaaaggcagtgggtttagggtgctttgtttcactgtgaacatgaactgtcataaatgcatatctgatattttaatatcagatatttggttaaaaaaaaaaaagtgaggtaggagggtgcatttcattatctctcccagatacgtactggccatctggtgggaaagaaaacaggcagtctcagtccagggaccagaggatctcctttgtccctgtacatacacgcaagaacgcacatattacattatccaggtagagagcacgtggtaggttacaaagaagccatgaggaagaaataggaaacctgaattgtagttgcactcctctcaatatcctcatcagcaaaatgaatgagttgttaataattacaattgtaccaactgtcatactttgccatatggcttgtatatgtgtttggtattttaaatctataacatacagtcatgtgccccatctgcatcaatcatggcatgtgtatatggtggtattttgtattttaccctactttttaatgtttagatacaaaaatactctccattgtgttacagttgcctgcagtattcagtacagaaacatgctgcatgggtttgttgtctaggggcaataggctacaccgtacagcccaggtgtgcagtaggctataccatctagatttgtgtaagtatactctatgttgtttgcacaacaagaagattgtctaaccatgtgtttttcagaagtatgttgtcattaagtgacacgtgactatacataaatatgttaatagcttgtaatgaagacataagctctaattctgatcaagcctagacaaagcaacttacatacataattcttaaaataaaaacccaaggaagacgttagtattccttgtttctggaaaaggagccaagaccctgggagttaagtggccttctatgaggccagatgactgggccaggacccactacctggctgaccccaaagttcacccttttattcattctgctgcattggttgtgacctagaatattctgttgtttttctggtttagagaaacagaaagaagactcagagtagactctgaaatgtccactccccacacattgcccagagccactggaggtacaatgtgccaggcacagctgtgtgggcagcaaggcacgtggagcaggaagcaaaggatgatgccgaggcacgggccacgtgtgcagtgcccgaagggggtctcctctggtcgtggctgtgcaccagtgacagaagggtttacttactatgatactggagaccaccatgatcactgacatttccttaatgatgcacaaaatgaagcgcacaagtatccaacaaatgaccagagaaaacgctagcatacttctctgaatgtacacttcagagaaggagggaaatgcttaaatgtaatattttagataaatcactgaatacaattagtatagtaagtacactatggatttgatggtatgtagtaatacgtctctatggcaagctcatctcctggaaaactggaactacatttgtccacaagcctttctcactgagcaggaacacagcttgcaggttggccgactcatctccccagattttattttctattttatctatatttttcctggctctaatttgtttctgttttgttacattttatagattcctacaaacctctttaactattttgtaatgcaagatatttgagcataaatccctaaaagacatattattttatgatgtaaaggtttcattttttccattttatagatgattaaatagaggcccggcatggttaagcggcaagcccagagtcagccatccaacgcagcgcagagctgtgatacaacccacttccactcccacggcatctcggcttcgtgggagttgaggagcgtctcaactgcatgtcaggagaacccatgaaaaggaaagaacccagaacaaatgggtgagaaagttcaagactatgttcagcgtaagagcaaaagcctcctgagaattctgcttgcagcccattcccaggcattacagtgcaaagctaattagggagaatggcatgagtagaagaccaccaagaccaccagctgaaacgggtgttctcatggcctccagtgggctcgactatttttatatttttaatattttggtccaatcactactctatacaacttagctgtcttaaaacaataaagccaaaacaaaaataaaacaataacccaggcctcccagatgttggcttcagtctgtgttcacaagttatcttcctaatataacagcatgagtactacttccccatactgttctcatgagatctatggccaggtccaaggtcacatcatagtaaatctttatgaaggttaagaaatttataacatttgcatttgttcacgaatgtcaataatcccaaccggcaggttttacgctcaggtttgaatgacactttgctaaccaagccattaaggtttgtttcaaggagtcgggggaagctccccagcagctctgagcaaatgaggagccagagaaaaacaattaaaaattttttaaaataagatctttgaaagtatattattaattctatcatccaataagtgttttcgaagactatgcaaatgacatcttgcggtataaaagctgttacagaacagaccttccaacatttctcagtctccttctttccttcccacgcatgccctatgtgtggactggcagcaatgtttttacttttaagaggaatttcatcatttgggaaaaatttagagatattaacgaaaaattgctatgtgtctcatggctacctactgattagaagcaattaacttatttctattttgaaaaattaggctagcaaatgaagcctgtgggagaagcatatttaataaatatagaaatattaattgtaggaagtaacaataacaccatgcaaagttgtcctgtacattgaaaaatcatactgattgtttacctccttattcacagcaagggaatcaagaccatagaagtcaacctgtagctgtataattgcgtccaaatcccagtgaagagtaaatgctaaagcattagggtgaacccattaaaactgagaaaagagagggaaataaatcaatacttaagagtagagttacctaccaaagtaccattcagttcaacacatttggaggcctctttttcatatatgatgagttttcactcatatacactgataaaaaggtgaagcataaaacatctagaatgatgttttgaagaaggtgaaagaatcactgtggtgaagactatagaactgccctgcctccatctctcctaggcactttagccattttactctaaagcagatttggagttgactttttaaatttcctttcaatgttagaaatttaaattagaaaatgtatgttaaagttgattaaaacttaacaagttattctgacccattttcctcttctactgcaattctgtctaatgtcttttatgatgcctttacaattactgttatcatcatcattattattttagtctatcatgtaggaaaatataactggattttgatttccttaagaggttttctacattatttagatttgtgaaagaatgttattgtaagtaaatagcaccaaatcttaaggatacaatatataactgctaacgcaaacagtatttgagaaatgcatctagatattcattactttattaaaaaagacatagaattggcataataaattgctagataaagcaattgagtaaagtgtaatgagttcaagtagagataagatcattttatggagataaatgaattagagaggttgtgattgagaagtgagaagtggttaaagtgttttaagacaaattataatatctaggtcttatccctacttatattgataggcatgatttggtgggaaaaaaagaaacattgtcactttaagtatttccctatcctaaatgaaagctactttattcaagagtataagctaccctaagtttctttattttaaactttgaatgcttcatcacacaaatgtttatattttaatagaaatgtattatgtctgatgatatccaacatatatatacaggctattgaattctatatgtagtaataatcatgaaactcagtgttttctcaattatatcagcaaattctctaacacagatatgccaggttttcttcaactttgatgaagtcactttagttctagtaaagtagaattccttctagaaggaatttaaaagaagctgaatttcctggcttccccccacccccaacaagcacctatataatttatcagtccatatttcaaactactttatttattcaattacaacacattccatggataattctaaaataaactcccacatttaaaattaaggagccacaaaagacacttttaaaataagaaattgcataaagagagaagaaaaaataaaatttttcacaacctacaaattaccaccaagttttacattgagtttgacattcctggtattcagagcaaaatatggacacaaagactcatgcacacactgggtgacctcatttcactgttgtatgtgtgattcctcattctaagtatagaatccaggaggtgcgggtccctttgtccccaccaggaaaatgcagttttccacagtgttaaggttggttacctttttccaatggcagaaaatgcaggccagaaactgagaaagttgctcagttcatacagaaagcagactgcctaacatgaacctcttagtagtcagagcgacatatgctattgaagtaatgtgttcctttattttctaaatggatccttcccaagtaaaatgtacctaagtacataaaccatttagtgggaatacatacacaaagagttgcctcctagatgtaaatgcctcttgaacaacaatcaactattaactcatgcaaaaatattttgataacattttcacaattatctgctaaattaaaggaaactactcacagcaacaaatgccatcaacatctggcagtgaaacaactttgaggtacatctggacaaaaatgactcatgtctaccctcacctgttgcaggctttacacctacagagaggcagctcctctttgccccaacatatttagtttctggactgcattttcgccttctgttgcaaaatggcaatcaaccttattaccgtagaaaactgcatcttcatggtaaggacaaaggggtctgtacattctggaattatattcaacacttacatttacatgaaagagccttgaaaacaatagaataattagacatgtttgtgagataattatgtcatgtaatgatgcctattacccaaagagctgttggttccttaaaaaaaaaaaaacatttatcagccaatcttgcagacttgtaggatctgaagaacagcactgttctcatcagagctaaaagcatatgctatgaatggggtcctccacatggcaatgaccgcaataaattaccagtgtgtgttctgttttcttgagatgggctcaatttatcattttattgaaaaggttccattatgctaatgtcttacaaaatcacattctgctgttgctggaaggtcatgaggggatataaatttttgcatttagaactaagaagttgtatagcagtcacagactccaagggttaataagaagccatcaaattacattcaaggacttatcaatgacagctcttcagcatgctctcctagttaacaaaagagaaaaaggggaatattgttccaagcttaacatcacacacacaaaaatgcttcaagtataaacgtattaaaacttggttttaacacaggttgatcatttgaaaaaaaagtcattgaaattttatctgtcagtgtgaagtatcagtataacaggtacatttaatacgagtttaatagaggtttctagtacatagtactcagtttgtttaaattagctactatcttcaaagactttcaaagataagtttgctgaagatctacaaagaatgcaaaaattaatatgcatattttagtgtaacctcattgtgtctataaggaggataatggagatttttgactagcatcaaatcccacatctcagtgagttcttagggaaaagaaagatgatgagctaattattcaatgcaaattagatattattccttagagaaatgttttgtttccatcttttcaagaattactgtttccttccaatcatgaaggactgtggatgtaattcacgaatatatggtgccatcaatctatcaataatttgcagttatgggcaacaactgtcaaacagctgagtaaaaacacataaaaccagatagctccctttggaccaattattgtaaaccatagaaacactgaggaaaaacagttgctctttagaaacacttggtatatacttggcatccaattttgtaatgcaacctaacaagcagaatgtaaacaacagtaactgcattgctagatttgtcattctgttttgtctggttcagcagctaagtggttacgaatattaacattctacaacatcagtgtaccttaaattcaagaggccattttgaatggatcactgattgcattttgatggaattcccagggaggtgatgagtaagaagccaggttgtggtctagggctgggcacattcaatcttattctgtattaaagtacagagatggagatacacaatatgctctttcctcacctggaactaatttgacagggaaaaaaaaagctttagaaatgggtctaagatagtttggaaacccaagttcacaaaattgtgtttaaaaatatataaaaggattatagaacttcttgacaaattcaaattattatataaagtttctcattgagtagctccaaacactgtcaaaattattttttctgtcagttatgtatgtcctgtcaacaggtatatgcattcacgccaaatgaacaggccatggaaagtagacatctctttatttgggaaaccattactcaaagattttaccaaaaaaataaaaaaagatttttggaagagcttggggtgaagtggttgtttttgcatcagggtatatggaattaatgttgattcttccaaatcatgatgactctaatgaatctaatcaagtacacataaacactttgatctaattcaaagaatatggaattttgaatcaaaagacagtggttccaatcttagcctcaatatcttttagctatgacagtttggccaacaatttcatctttactctcagttctccataaaagaaggaatgataattatggccctaagagataatgtaagtgtaaatgtttcacaaactgttagaagaaagggaaatacttattattctcttgagcgtaaaatattgtatctctctggtgatgtaatggttgcagggagcaaagtatatttaccaaaacattttacatattaaataggactattttagtttcattctcttaataatcaaaaaaaatttgaaacttagaattaaaccaaagagattactggtactctttcaatgcgatgtaggtttattatatgggctattttacaactcggtaggagcagtggttcacttttttccagtggaaatacaaagaatttctgtccagtggagcagacaacctcaaatattatggtttattgccctgtaaacacttgacaagatttgtatctagtctagcaatcttatgctaacatctctttattaaattgcatatttacctatctataatcaagacactaatttttccaaagccttttgaaccaatttatacagcttgctgcttctcacattaagtaataggttgaagaaaatttttgacacttgtacattttatatctaatataatatctaatataatataatataaaatagcaaaacagctattttaccttactggaaattataatttaatggttttagaggtcacgctcaaatggaccaaataaccttcatttccaggaagtttgcctcatggactaatatactaaggaatagttcctgaagtcagacagatcttgaaatctgcaaccggggttctccactttttcccctttttcttttctgaatttgtgtgtttggttttgcttggagcacagactcacaataatctatttccctttggtggtcacagtgattgggaattgccttgatagtctgactggcaatctctggacctggatgacacagctttattctttgttgaataagagacaacagagactatgtgtaagtcacttgtgtttacttatctcttggtgacctcagatcaattaaaaatcatatgcccactggggaggaaaacagctctttgaggtctggactaatacatttttgtgattctctatcttcttttgacgcatgactgaagttgtaggactgaagctataaattctctacatggctttgcgtctacatatctgtaattcacaaaagctgttgcctccgttgtgtgaaatgtttccctgcttgttgcaggctgaattacgtcaaaattcctatgttgaagctctaacccccagcacctcctaatccaactgtatttgattaattataatgaggtctttcgggtgagccctcatgcaatctgactactgtccttataggaagaggaaatttacacaccagacaagagggtatgtagaggaaaccccgtgagaggaaacggagaagacggccatctgtacaccaaagagacatgcctagaaagaaagcaaacctacaacaccttgatcttggacatttggcctccagaaccacaaaaaatagattttggttgttgaagaaaaataaataatgacatatacaaatggaataccggcaaaattcacagaaaataaagcaaactctgagtacttcaagtgttctagatttttagggaaaaatctcctcttatagaaactgcttgctcagaaatccaatcacatacatatggtgaatctttggacaatggaacagttttaataatttgggtttaagaaaggaaaaacttttctctcatttttcagtgttaaatatgtgataaggtttctattttacattttaacaggttggggtttggtttcccaggaaaagcgtacttaatccgaacttctcgtacttctcaaactatttttcaatcacaaaatcttgcattacagtgacataattttaaagttttttgaaaaatatacatttttagctgactaaatagaataataattctggcaagtttttctgtagtaggttcttatatctttatatataacttgcaaacatggattgatcttcagacagctaggtaatttgtattaaggctgaaaacaaaagcaatgataaacagacataatatttagtttacatatttttggccctttagttatacatactatagaatggctatatttttgagtcacattaattgttttagttttgctactttaggagcctgtagctctaaaaattgtactatatatatttatagctttgttagtctgctaaaatgtttgtgtttgacacacagctctcctattatgactttccagtttctttgtgaaatcaaagatcttattttgaatacaagttataatcggatttggtggctgagacttaaatagaagaaacagtaacagaaaaatacaacgatttatccaaagtaatgggatgagctttctttttcaagaatgaaaagaatagggtattttttccctaaagcaaagtgttgttttgtaccagtatatgaaatgacaccgtgaaagataaaacttgagagaacacagcaagttgtggaaaatttgagggaagtgaattttaactgcttttgtttataacacctatgtctgaaaagaagctataaaatatattaaaattcacctaattttgattggcttatttgtgagataaattaagggggaaaatgatctcataaaacctatatttccaatgcattaatgcaaaattaaaagtagtctttttcttagttgaattaataaattcatcttagaattcttaccaaggcatagtaaaaatactatttttcccttttgtgtgatatgaccagaaagcagagattttataacccaccagaataatctctgctttgtgttgattctagcatagtgttagaaaataaaaatctacaattatgaaaggcaaagtttcctcacttgtgaatgaaccaagattccctgcaatcatattacatttaccaacaattatttttgaacacttgttaatttgattaaatcgataattaaaggcacctaggattttattatagccaaacgaccaagtctactctgacaactactttaatttccccccagccccatgatcagatctaaaatttaaaaatatagaccataaaaattcaacaatatactttatacttaaaactggctttaaaatctcccacaggctccctggagagaggagctggaaagccttaggtttgtttcaagggttttgtatttcttaatcacctccccactacagaagagctatggaatgagctgtcaaatcagaaggacgctcagccttccctgggttcagtttgtgtacatgaaatgttatgcacagaaatctgttactaatcgaacattttatgggaagaccaaggagagtcatcagagcccatgctgtccattatatatatgttcttactctccggagaaacattgatcaaactcttataaaatagtcatacactgtgtcacaaagggttattttacactcgtcattctgatattgctggtcactgtagtaattaatccagccttttattagtatcaaactggtttctgtctccatctgatgcttgcctgagaactgtgctataaaccacaggcctggggttgtatcttcagcgtatactcctgtttccagacttctcagaaaggagtgtgccagatactctgaactactgatacttcaaagaatagactcttgggtactggcgttagagctgacatcagctcaacaactttcagactgtaccagggaatgaatcagaatttccaggacttattttagtctggaaatagatgttcttcatgaaactagcacctaacccaagatccaaaaaataacaattaattacacaagaacaaatgaactgatgagttaaattatggctacttattttgaatgtttttagtattgcatttaatgttaatttttatggatatatgaagttctctttcttcttcatcagtatcactttggatataatagactattgcttttgtatataattttttttttttttaagacagagtcttgctctgtcaccaggctggagtgcagtggcatgatctcggctcactgccacctccaccttccaggttcagtggattctcctgcctcagcctcccgagtacctgggactacaggtgcaccaccaccacacccagctaatttttgtatttttagtagagacgaggtttcaccatgttggccaggatggtctcgatctcttgacctcgtgatcagcccgccttggcctcccaaagggctgggattacaggcgtgagccaccagctgcttttgcatataaaatttaaaaaactgtaagtagtatctgatttttagcatccttcgaaaggcagaaagaaatacttttactgattctccttactttttcatgagaacatagttattaacataggttcaattaggatttgttctcatcttaccaggatacaattgaacaaattgattatgcaacaaaggatacacatggagaattatatatgagaataaatctcacttcatcaaacacagcggcacgctagtccggaaaactgacgagacacgtagctagtgcctacgaagcccagtggacaaatcaggtttactacctggctattagagtcctgttcctgagaacttcaagaagaaaggaattcatcccaatttatatatacagtgcaggcaaaatatggtggagagaatgtcttggaattgtttcccgagctttgagaaagaaaagcaaataataaaggcttttaaaagtcaaatctaagattccttaaaaaaaaatctcaggcagaattaattatctgggtcaaattatatggctatagatttgtaaagcaaactcaagcaggcctatctggttaattaacagtctcattggaactatgtaaaaaataaggccatgtttcatctggatgaaaatagcatttttctgtgattaaaacaaaacaaaacaaaacaaaacgaaacctttgtgggctaggtgcagtgtttaacgcctgtaatccagcactttgggaggccgaggcagagggatcaccttgaagtcaggagtttcagaccatcctggccaacaggtcgaaatcctgtctctactaaaaatacaaaagttagccgggcatggttgcaggcgcctgtactcccagctactccggaggctgaggcaggagaatcgcttgagcccaggacgcagaggttgcagtgagccgagatcacaccacaggactccagcctgggttacaacagagcaagactccgtctcaaaaacaaacaaatgaaaaccgttttgattatttataagggggggggcagggaatggagtgtaaaaaaatagccacaacttagaaatgggccaaatagacaactagatgtccttttggtgcagcgttgagcttgttttcctattggcagggagctgtaccactttgtagaggctgagataccttgtacatttttgtttggtaaagatttccatccagtgtaacagataaccccaaagtcaatggtttaatatcctcccatttatttatctctctcacacacacacacatgctagaaagaacttttcctttgatcctttgatgagtacacagaagtacagagagttgtataatgagtaaccatcccccagattcaattataaataatgtgtaactagctggttgtcccacttccactgatcctaagattgatcacatggcatcagccagattcccttcacttatatcaacccattcactttcatctaattgtttcatctatttatatctgttggcagaataaagtaggacttgcaaaatggtgaatatctaatttcgcaatgcatctccaattattgtctgaaacttctctgtaaagaaaaattttcctcaactactagggctatttggttaccttgaaatagaattcttacaggaaaagctagataaacccttattttatttttttaattatcaatttcctgagtttgattttagggctctagttatttccaggagtttctaatgtatttgggttttttagcaaaattatgacttgttaagtcttcaataacttttttgtcttagattacacttgttttcatcttggattatcccatcttgggacactgaatcttcattagcccctgtgtccttcaagtatgtcccttctgatttcataatctccactagctttcaaataagatagccacacaagatacacaaggttcatcttgcatatgatttgtcccaggcctaaaatcttctattcttcaatgattccttgtcttttttagttaaaaacagtattaagagaccacaatctgagtggccacaaacgtactcctagttaataggtttagatgaatgatccagacactctacctgaaaagaggggagagtgggaggatcaggagacaggaaaacactagtacatgaagtgttaaaactggctgctcatcagaatcacctgtgaaaccttcaacatagagattctcaggcctcaaccattatggaatatgatgatcaaaggggagcccaggttatgtaaaaggccctaaggaaatgaagtcactccggggcccactaggcgggagtgctgagttacagtctccaagcagccacatttccagaccttgggatccagtatattagatatgcttagcagttgaagaatttctttcttatcttaaatagtaatacatattcattctagaaagttcatataaaccaaatattcgaaataaaaataagtcacaatcccatcacaagaagaaactgctattaaatcttgcatctgcattttaatattcttctttatgtatgcacatgcataaacggggatatatatggttagttattttttatagagtaagatcacaaactactcagtaatttggaattgaattttgtcatgtggtgtctttccatgccattaaataatattctcaacatcatcttcaatggatccatagtgtttcattttatagaactgccaaacattcagaacctatggttgtacctcttgatagttttccattttttactaatataaacagtgttgaacatccttctagataatctactgtgtatatctgtaatataattttatcataaactctgagagtataaatgactaagtcaaaaggtcgaaattgcattttctcttgtgagaattctaaaataattccctatcagtttaaagtaagaaaagtctagggcacatgaaaagaactagaaatgaagaagcaagtgtgcataaagagggaaggaaacatgctgactcttatcttttagagctgtcacacattgaattttaatgtttggggaaataaccaatgtagctgttaggaagctgtgattcaaacatggtagcactaaacgatacatcactgtattgggggcaggtgcaacataaacct

SEQ ID NO: 1122 - DNA, 168761 bp, Homo sapiens
tcttactcccaagtttgtcaaaaaacaccagtctttgactttttctctaaatgaaaaccccatagaatctaagttccaagcccaaaatttatttgcaaaagaaaggaggaaggaatgaaggaagaaggaaggaaatacatattatgtctatttaatatacactatgcacttctttaatatattacttattacatatggatgcatttttatctgttcattcaagaaaggatatgtcaaatgcctttgcttgggaacacctacgttcagtttgctccaaacatgtacctggttttcaaacgtcccacactcctgcttcacagggaaagatttgccattatgcttagtggtgggaatctatgcaaatggttccacatgccaatgccaagccaaaagagaaagacaagcctttgttccagaagacacagccctttacagccctttgaatccattcctctgggagcttccccatgggaggactgcttctttctgtgacccagcctcactaaatgcactaggaatcagcgcacttcactaaatattacatctagatcatgtgtgtatttactataattatgcatatttcatctgaactaattttcagaaaccctttccttagcaaatcgcacattttacgaaatgtcagtgtttcctaccaaccaccatgaaaacaacaacaaaagctgaaacatagcaggaactcaaatcgcagagtatttcaaatagataattagactgaattctaaagttctctaactaccatatatgtaatattaaaaaggtcattaaattgttggtgtgacagggttagttaaacataggcctagcagccagtaaagatgctgagtgcagtgacaaagaacggtgaacggaggacctgtttgtgaaggatgaggattttcctgcattcaccgttgagaagtcagtcttcataggatggtgctgagtaggactagatagatttaatcaccatcacaggaacaaactcactaattatagtagcagtgacacaggacaggtgagacccacaactggggcttagctgaggagggttcttgactttgcccaggaaggaactgaggggtaagtcagtggtgttaaaaagcaatgtttactgaagtggcggtgtacagcagcagcagcgctgccccgtaggcagtgtgccagggcagcagctcagaggcagcattgcatccatatttatacccacttttaatttcatggggtggattatgaagaaatttctagaaaagggtcaccaagttgttgtcgtgaaaaggggcagtaactcccaagtgttgccatggcaatgggaaactgacacagcaccctggtgggtgtgtcatatggaaagctgcttccagcccagccctattttagctagtcctcaatttggtccagtgcctgagccccacctccagagttgacttccaccttctacatcagtaagacaaagaaagtcgcaaagttggaagaatatacagagagagataaaagctgtattcaggaagtagatcctttataaaatccactagaaaatacaactgacttagtaatagccaatgacaaaacactgcatgtgcagaaattcaggactttatacaagtaataatgagtgaggacgcaaggcagccctggccaggacgatgaggggcagagatgatacagggaccagctatggctcttcggaccctgaccaaggaaggaaagctacagatgagtaaacagagttgactccatgagctcagcagaaatagggtgtttgtttatgtgtttgcagttttcaccagttcttagtgagaagttaggagttacagtgtgcactcctctgctatttatagtctgatatattaatacaggagctgtcttggccaagctcttcctctctacagatgctgtcccttaaacactttccaacatccaatgagcacttatacaaagattgctttttatttcatttaccgccttctcagctgtttatgagtcaaactgtttcctggtactgttgctgtaggtgtatattggacattactcaggatctgaagcatatacaatatccccaagcttaaattagtcattgtttcacttgtcaaattcaattaacatcatatgccaattgcataccatgaatcatttagtaaacactgtctagaaatattaacataaatcctgtgttttacttaacactatgttgaattctgttcataagtttgttgtttgcaacagtttaagttttagtcaatttcaaaattcttttgaatgtactatgtgtgtgtactatgggataaaagaaataaattaatatattgatgtttacggtaatgtgggttctcactatgggaaaaggtagatatgaatactgaaaggggaaaggcaatagataattctatggtattcctgaagttatatgaatgaactcattaatgcacacagacacacatacacatattctaccatatagtaaaatggtctagaagcaaaaacattggtagcaacgtttatgtctaaatgtaacagccagatcctagggtttggtaaatagaagatgaacctggaacttctgtgccaaaaagcaaggactcaaagaccaatgtggacatatcaaaactatgtaggagctgatttaaaggggttcatttttctcaaactgttctttaaagaagaatgctaaatggcaaatgtaaacaaacaatataattataaatctttctggttttttggaaaccacaaatgcaattatttatttgggcagaaatagaaatgaatccttaaaaagaccgttgaagaatagcatcttgacatggtctgaaagcagtatcccacatcttgtctactaattgcataagaaaaaggcaaccttgaaacaggggcgatgtccttttgagtatgaaactcacaagggagagactttatcagatcagatgctagtggggatcacaaacgccaccagatgagctggcgttctgtgttgctgatgggatgtaatgtaaagtacacaccctctaggaaacggtcttgccacacatgcttcacctgaacataccatgaggaaaacggcaggacaaatccagattctgagacatcccaaaaaaggactggcctgacgtctttaagtatgtcagagttgagacagacaaaaagtggcaggaagttgtggctgacatgaccagaccgccaaatgcaacgtgtgggcttcacctcaaccgggagaagaaaaacagatgtccacagaagacgttcggagatggatgggaagatgtgcacaagggctgcccatgaaataatatcactgagtcaacgtacaggcatggtgatggaacaggatgactttgcatttaagagatgcacgctggctggacacagtagatcacgcctttaatcccagcactttgggaggccaaggtgggcagatcacgaggtcaggagatcgagaccatcccggctaacacagtgaaaccccgtctctactaaaaatacaaaaaattacccgagtgttgtggcatgcatctgtagtcccagctactcgggaggctgaggcaggagaatggtgtgaacctgggaggcagagcttgcagtgagccgagactgcaccactgtgctccagcctgggcaacagagtgagactctgtctaaaaaaaaagagatgcacactacaactttcaaacaaatccaccaacacacacgcacacacggacgtgcacactcacatacatacacacatgtatcatgttttgtgtgagtgcggggtgtgtgtagcatgggtatttgtgtgtgagaaggaaggcaagtgggtcaaaagataaagaaatggtgcatagagtaaatcactgcggtactgtactagtctttcaagttttctacagtctcacaattaaaaaaaaaaaggtggagaaaaattttcctggagagagaaactaaacaaccagaagtttctgatgattgaattaaatcgtttttcagtatgccaagcctctgagcagctggattttccacactttagtttgttgccctggggcctcccagtcttgcttccataactcaacagaattctaccaccaattgttgaatccaaagtttcgttccaaagtctctgaaagcagaaactgtgttccagatacagagaatcaaaatgcgctactgaagtcatccagaatatcagtagccaagacatgatcagagagacctatgaatctaagccagttttctgatttttaagccaaattgtttatctccattcaacactctcaatacttgtatctacaaacatattggactaatgcagagagcacatttccacactggaacagttgaatagggatgtgaaaactcgaatatctttgcaaccttcaaacaacacttgacattaaaaatccatttacaaatccagctttatgctaaatattgtggtaacattcttaaagaccagacctcttcatgtggaaaatgatgtcccagtctaaagttttttgaaaggatttgctatgaaactgataataattttataggtattcatgtctatacaattactaggactttttttacacagaatacctaagtttctcctaccttattgaagattcttattaaaataccacatattaaaaaagataaagtaacacaaaaagtcacaaaagaattgaagtttacttttttgctttatttggcccaacacagtgtcttctagaagtccttgtcatcacaaaaatataaagcttcctttggatatgcactccccaacctgaattgtaagcactttgaagacagtaattaggtcttccatcacactttagataatgtcctaggccgggcgcagtggctcatgtgtataatcccagcactttgggagtctaagacaggaggatcacttgagctaagacaggaggatcacttgagccccggagttcaagatcagcttcagaaacatagtgagacccccatctttacaaaattaaaaaaaaaaaagctgagtatcgtggtttacacctgtggtgccagctactcgggaggctgaggtagggaggtcaaggcggcagtgagccatggtcgcgccactgcactccaccctgcacaacagagcaagagcctgtctcaaagaaaagaaaacacaccatgacgtcctgcatatatctgcctctcagagaactgattcaccgatttcatcgtttaaaaccaatgcaatactttcattttcatgaaaatggaagcaggctttcatgaaaacagtcttcaagttcatgttacacaaatcctacagaaattgtggacaaatgatctgacatcctcctataaaaggatgagaagaagctgtgcctcatgtaactgatcatttctatgtattaagccatatgaaatatcatgtctttgctgagcagaggctacaattagaaaagacccgatctaaaagaatgctcaaaggtcatcaagcatgattacattctgctgcacactgtaaaatgcatccaagtgtaaaggattattcaacaaattatgaatgattcattcatggcagatttttcattagaaggtaatgtctcctttcccataaagtcaacattatgatccaggatgccatttattagaacttatgctattaaacaagatatgaaaagagaatcttcttaagtgtctcacatcagttaaattaccctccacctgttggaaataagcactgtggtcaatgaagggagagggatatgtagtacatgtgttacaggatttgcaagagttatgcttatgtatatgtatacatgtacacaattttcattactgatctttcacttatgtctgaaagtcaaatacttactccttttgcttaaaattttggactctaaattatcccaggatcggtagttaccccaggacagcgtagtagttattaaaaagtcaattagatcccatttgtcaattttggcttttgttgccattgtttttggtgttttagacatgaagtccttgccctgcctatgtcctgaatagtaatgcctaggttttcttctagggtttttatggttttaggtctaacgtttaagtctttaatccatcttgaattgatttttgtataaggtgtaaggaagggatccagtttcagctttctacatatggctaaccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagcgtgatgcctccagctttgttcttttggctcaggattgacttggcgatgcgggctcttttttggttccatatgaactttaaagtattgttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctcctcgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgaatattttcacaacctactcgtctgaaaaagggctaatatccagaatctacaatgaactcaaacaaatttacaagaaaaaaacaaacaaccctatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaacggcaatcattaaaaagtcaagaaacaacaggtgctggagaggatgtggagaaataggaacacttttacactgttggtgggattgtaaactagttcaaccattgtggaagtcagtgtggcgattcctcagggatctagaactagaaataccatttgacccaggcatcccattactgggtatatacccaaaggactataaatcatgctgctataaagacacatgcacacgtatgtttattgcggcattattcacaatagcaaaaacttggaaccaacccaaatgtccaacaatgatagactggattaaggaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcatattcttactcataggtgggaattgaataatgagaacacatggacacaggaaggggaacatcacactctggggactgttgtggggtggggggaggcgggagggatagcactgggaaatatacctaatgctagatgacgagttagtgggtgcagcgcaccagcaaggcacatgtatacatatgtaactaacctgcacattgtgcacatgtaccctaaaacttaaagtataataataataaataaatacattaaaataaataaataaataaaaatttgacatgtttccaaagaaaaaaaaaaaaagtcaaatgagattttaaaatatttcccaagtgttatctgagagatcactttgagagaaggaaagcaagcggtgtttgtcatgagcttcgtccaaatcagaggccttgagtgttcggaggatcatctaaacccatgaaaaaaatcagctggcaggagcccatatgggtcaagatggcttctggagatagataaaagcggatgtctgaagtagactccctacttcccagctgtaactggcagtagagtaatcttgctaggaccaaatatcctttggtactgcatacatcaatagcactagctaaaaagattgatctgagttatccatttattttagagtttaaaatacactctccacagcatcttttttccactgggaatccagagatgttttacttcccgtctctataaaaagccgcctcacaatttacagggccactgcccactcttcatactttaaaagatatagataggaattcagaagaataagaatccctccttatttgcagatcaaatttacccttcagcaaacttcatgggctgacacattacccttgagcagggggtatagatatacaatcattaagaataatcaccaaatatttcaatttacttgatttaacaagcttttaaaatccattgcaagggggtaaaatttgattaataaactgcaggccacataaggatcttgtacaaggtgacttatttaactgactccacagaaaagtcaacaagcaatccattgatcacaacatgcaaacaattcctacttgagtgtcccactggcttagcggcagatttgggtctcaattgctgatcaatttctgcattatgattctggcatgaaacagctctctaggaaagggacgacatcataaagatgtgtataagagaaagaagatggctgagccctggcctcacggactttttgtcacgcccttttcaatcagctagaatccaatctgataatcatttactgtgtcttaagggacgagagcacgtgtgtacattagatcctgtatacgtttacgctgcacatttagattgagtgtgtactgtgtgcctgtcactaccataagtcactatgggttcagagataaaacaaatagctctatgtaaggtgctcacagtctagacaggcagagaataggaaatatagaacagcaatacactgaaataagtgaaattgcagagatatgcacaggcgtgaaagtcatttagagggtggagaacataggggagttttgagttgactgatggagctgaaatatgggcaaatgttggaaaggaatactttgcaccagactgcaaagatcaaataataacaaattcagggatgtgtgttttagtctgcttatattgcagagggactgaaggatttttaactgaatgacagcatccattccaaacttcatcagacaacaggatagaaggcagagtttcagctcagtgaagtatgttttatcaaactgtccaggatggtttctgagtaacacataaaaatgtaaatcactgtgggaaagcagctgtaattcacgatgacataaaaaccactttaaatcataaacacaaagcagggaaagaaaaagcttcttaaagtgggaagggagagaaagtggggcttaaaatagataatgaagaatgattttaaatcttgttatgctggcacgtaaatggttttgcatcagacaattctagagaaaggtatgtgattccaagtgggagtcatgttcaggatgagatacccaagcagtctgacatatgcttgcagtctactaggcgtaggctttcgccgaagggcctaagcctaggggaggcttaatcacagatcccacgctgtggccctttccctgcatcctggccatgtgaactatagtaaaagtgaaattgtatgagactgcgagaaagacctatgcatttccaagccaagtctccctcagcaggtggggaaaattggggggaaggtacagaccatgtccctgtaaaggctgctcagtaactcctatgctctgaccagctcttgagatggtgtcagaacctgttgatttccttctccactgcagcttgattcatccacactaatgcagttctgcacgaacaacagcctcaagatggaatcccaacacaggttccaggctccatcctttctggagtcaggtttgaggacaagccttttacctctatgcacagagagaaacatctgagtgaatgcaactgatggaaatcaaatatttaaaagtaaacatttttgggccgatgtggtggctcatgcctataatcccagcactttgggaggctgagatgggtggattgcctgaggtcaggagttcaggaccagcctggccaacgtggggaaaccttgtctctactaaaaatacaaaattagccaggcatgatggcacacacctgtaatcccagctaattgggaggctgaggcaggagaattgcttgaacctgggagacagagcttgcagtgagccaagatcacgctgttgcactccagtctgggcgacaagagtgaaacattttcattaacatttcaaattttaaaaatgagtatgattgggccgggcgcagtggctcacgcctgtaatgccagcactttgggaggccgaggcgggtggatcatgaggtcaggagatcaagaccatcctggctaacatggtgaaaccctgtctccactaaaaaaaattagccaggcgtggtggccagcgccagttgtcccagctacttgggaggctgagacaggagaatggttgtgaagccgggaggtggagcttgcagtgagccgagaacgcgccactgcactccagcctgggctacagagcgagactccatctcaaaaaaaaaaagagtatgatcacattaaaaagaagtaaacatttcagcttagagcatactacatttttaaaattaaatgcttcccctagttttcaatattatacatgaatgtatttgcttcatttttacaaacacatggcaggtatacatgaagctgtggctgctcagtcaatgccaagcaaaaggcctgaagtcctaaccttgaaatgcccaatgatgagttaataaagtcagcaacattaacatgtgctcttttacagccaaataaccaaccacaaccaaaagagtatttaatatttgctttcatttataaggtaaccagtgcattacaaaaaagttaaaaagcctacgattctctgaataacttggaactcctataagcaacacttgacaaattagcaacatgggcgtggaggtgtcctggcctttgaacacgaagatgatgatgtcttccttgtcatgctgccagtctagagcacacatagacttgcgtttctaattatgataataactcatctggccacatccacagatcatcccattgcatttgtgaccaacagcacacacgttcaaaatagctggttgaaatgaggtatgcctattggttatggaataagcacagggaagtgaactaatcagatagatattatagtagtaagtgagggtgaatttctacttcagaatagataccttcaaagatttcctttaacaagttcttgtggatcctggtagacccaaagaaaaagcacactttttcttcttagaaaggaagtgaagataccttattagttatgagaaaatatgacagactttgttccaaagcactgcaggaagtgctcggtaatcctgcaattggcacaaagtctacagggctttaaatcaaggggcctcgggatgatcagggaaaggactgtgaataagctgccaacctgtgttttgccttgaaggctgggcagggctgtcaggtactcagacattttctctcacctccaaactcttccacactctgctctggatgctatagacacaactgtgccaactacttttcccaaaatgttttgccagctggatttggtgagctgtcaacaggaggcaggaattcacaatgcaggagaagaggcaagggaacttccttattcctgtctgcttgcggtttgtgtcagcaaaatcacatgagctcaagttccccagcagtggcgcgctgtcccagaagcagctgttttttcccctcctctggcttcttttgccacttccaagaacagtttatcttgcccctctaaggagccagtggcaagcgggtctttaggtaagaagccttgaaggaagggagaagggctgctttctctgggaggggagaatcagagagatttggaaattcaaaatcagctttgtctgaatctatttagatgactccagtctcagggtccaatatcttgccaatcactctgactttcacacacaaggctgtttgaaggttcttgaacttaattgtaattctgtaacattttggatgttattttctgcaactcagccctatgactaagaggggagaaagttatcattatctttttagttcttcaggccaaaatagaagttctctgttttgttgttgttgttcttgttgttatttcaggtagggtcttgctctgtcatccagactggagctcagtggcgagactgtggctcactgcagcctcaacttctcaggctccagtgatcctcccacatcgacgagtaactgggaccacaagcacacccagctaatttttatatttttttgcagagacaaggtttcaccctgttgctaaggctggtatggaactcctgggctcaagcaattctcctgcttcatcctcccaaagcattgggattataggcgtgagccactgtgcttggcccatttattttttataaaaagtatcccgagtttatgatttcctatcactagacttctagccatttaaccccatagtccttgtcatcatcatttctatcatcacaggtaggtattgcaaggactttcacctaataggacaaccatgagctggagtaagggaaacatacatttctgctcaggattatcagctctgaactgcaaccaattcatggtaactaaaactccatgttggtcaccaaagtggaggcttttggtggtaaggtgataaatggatgaggcccacgtctattttacggagattgcagaaggttcagaaatgcatcacttggttatttttctagttcctgaatatgtaattagaacagacatttgcagcaactggcagaattcctgcatgtctctctgccccctggtgtgagcgatattaaaccagagccaggaggcttctaaaatatgaccttcctaccagaggatgttaatattgctgggggaagggcaacgattaatatctctgtcaaagatttgaaaaaggcaagtctcatctacttactccatactcatttaactcacctgtttggcccatgcacaaagcagttggacttagagaataattgtgaattaccataaatttacttagcttgtgattgcaattgcagctgctcttccagatatgatattttcactggaacaaataaacacagctcctggcatctggcagtttacaccttttgatcaggcaaattaattcatagcaactttcaaggatcaccaaaagccatttgcttttgcttggtcgggtccacatagcacctgcacttttctctgggtgatgtcaactctcctgctctttgtcctgactacatttgcagaaatgttgatcatgcttacctcaaactaactatactgacaacatgtaccacacagaccagatgaacagaaaatagcaaataccttaaatgtctgaataagatgtatgccaacccgtggaaaataaagcccatgaaaatgtaggcaccatcattttagtgaagttcttgggggttgaatgcttccgagcatgtgaggatataccctccaagttaaaaggtgagtttctggaaattgcaatgtgcttaccactaaaaaagaaggacagtacttgatgggcctccttgggcttatatgtcacttgtactgctttcacccatttatcaagaaatgtgtaaggctaccagttttgattggagtcttgggcaagagaggactgctgcagattcagatggcagtgcaagctgctttgccttatgacaagggccttatgatccaacagatacaattatatgtcaatgtctatgacaaacagaggttctgttgtggttagctgctgggtcctgatacagactaaacacctcattctatgaacataaagaaaccatgtggggtggccatgatgaaggggatgagagctggcctgctgcatctctgctggctcagctcatacctgtggactcctaggagagagaattttgaccaaatcacataggaatgaaaaacctcaggccttatttacagatgagcagtacaatatactgtcactaaaacactggttgatgcagcatgtggttatttacttggtcaagattgagacagaagtataggaaacagtgattatttggtgatcattaggggtctggttggaaggtaaggggcttggaaagaatgggattagaaggctgaaaacaaattgttcttactgaatcctcaaaactgagtctccagtgtgaagatatctgcactccatagaaatgctctctcaagggggttcactgcagaggaggctgtcagtaatcgggccaacaagacgacatgccctgtgaatgtcatggagcctctttcctcagcctctcctatttaccagatgaatcctgtggcaaagacagagctatgcttgggcagcatacaacctcctctcgccaaggctgatctgctaccaacactcctgtgtgctcatctcctgcagcagtgagtgctcagcatggaacagggcacagttctcccagaaggggcctcttaggagtgggttgattactttggacccttacattatgcaggaggcagcaaacggtcctcgctggaaaaggcatttattttgggtatggattcatcattcctgtctgccttgtttctagaaaaatcattgtccacaggtttatagaatatcctagtcacgatatggcactcacacacatgcttcagaacaatgaactcattttgctgcaaaggaagtatggcaatgggatcatgtctgttgatttttctcatattatcaagtctcccagaagcagctgggctgatggactgctgactgacctagaaaagccttagtggtggtgtcagtaggtgacaacatttggatagcctggggctcaatctgttctatctatctatctatctatctatctatctatctatctatctctgatatatatttgaattcttatatatgcgctgacccagcaaccaatatatggtgctgcttctctcactgccagaaaacacacctgcagaatcaactggatgatgtgggagtggctgctttcactactatatctaataacccattcacagaatgtttcattcgtgtcttctcagctctgggctctgctggtttaaatgtcttcgtacccaagagggcaaggtttccaccaggagaaacaaaaatagttaaaaaaaaaaaaaaaagttgagactggtacttgcccattttgagttccttaaacactgaagtaacaagaaaaaacgggggatactatgttgcctgggatgctggtcacaatttctagggaaaaactgaattgctactacacagtagtgagggagagaaatggatctcatttacaggggaattcctgtggcagctcatggtatttccatgtccaaaagtacaagttaatgaaaactatggcaaccaataaagattaaactgttgggtatttagagctttcaggaatgaagatttgggtcacattatacaatgggaaaaaaaggcaacctccaaacagattatggctgaaggaaaaggtaatagaagaggaactgtagaaaagagatgttataaacaaatataaacttatcagttatatgaatacagtgtaaatataggtatgtatatggtaactaatatttcatttcttctttaccgccactagttacttatatgtttgtaattttgtggttaactttatcatttaagttattctttaggttataagattctgttgcaagtaagaagaaactacaagagaaattaacatcttttagacaaggatagtatgatggttggaaattgtgtcttccattgctcaggagaggccaagagagtgtttgaacgaatagttattttttattaggtatacccatggagtatttactgttatgaaaaggaagtttgagtatgtgcaaagcagtatatgttctgaaaagatatggtcagtgtggacccaaagggttggtcaatatgaattacttaactattgtttctaacatcaaaaccctccatttgtattctattctctaatgttttgacattaaattactcaaaactcttaacagctagtttcttgttagactataccgagaggaggcactagagggagactggaaaacaagaggaagggagaaggggcttttcttcttcctgttgagttgattgccctgtaagtatcactctggcagcagcacacaacccgagcaacaattgcttctcccagaagcagcacttagtccaagcaccagctgttgtttccagcctctagttagttttaagcaaggagaactagcctcatcatgccattttgatgatccaaacccagctccgagaaaagtcccatctgtgagctttcagattctgacaaacctactctcttccacttcctttcaccaacaccagggctggtgggagcttcttactgttagcatgtctcaattcccttaatatttcatttttgcttttcagttttctaactctgtgtaatgaattctctacttaaaatttcctctgcaaaaaaccagtgggatctgtctttccctcgctgggaaagggacagagcagggttttaatcagtgaggttgggagttcactacactacattaagtacaaagttgtaaagagcctaagccagggatgaataacagcagacattaagcaagaaaagcccattgagctggaatctgatttgaaatgcaattgaaaagggagaaaatcaaagataaccgcaggctctgtggctgggtgaatggagtatgaacgttgaggttgtgggtgtggctgggagacattgaatttgaggtgtctggggagcataaagatgaacattttcacaagcaagtgagaactgtctaacatccaagaaaatgccacgggattaaaaataaagacttgaggagaatctgcagataagtctatttcactctgagggagtataagacagctggataggagagttttgagaaggaaaaggcagacgccaagaagtaaccttcgggaccatccatgtttcgggtgctgaggagcatggcaagtcagccagaacaattaatcagggttagtcatggaagaatgactaagaaggaatgaaatccctcagtcaagtgtcaaagaagtcagggaagtcttagaaagtgggagcctggagaggaagtcagggtcagtggtgccaaatgcttgcataggaagctctgccggcatcaagtacgattattatagaaagtgaggaattctctcaaatgccaccttccaacctgccagctgtcctgtgggaatgtgacacgtagtcctcagttctgatttaataagaatgacactaacagttagcaaacatagaaacgggaaaaacgctgccaacatcgtgtagcacatccctaaatacagcccatagggactgtctccacatgcttcagaatccagccccggagctccacgaataactgcatgtgagtccacgggcggcaccacacctcagagggagaaacacagccccccttacattctcaaggaggcgctgcttttgatcttttattttcctttgagttcttcactggcgcagaactttgttctatttgattgcaacatgtaaatattatcatcatgtcttcctttattagggacaatatttttttccctacaaaagacttgagctgaaagacataaaacactgtttcagtttcaggaattctagggaggattagaagaaagggttagaacacgattacccctgtggaaatctagggaaaagatcccatacctattttcttgtctttacccacccaactactcacaacccgtcacttatacacaaacaaatagtcactgtgcaacacatcttctatttctggtaacgtaccatggccaaagtcataaaagggtcaattattgaacctggtagagctggtggcaattttcaaacagaggcacaactcacatttaaagatgatacatggcaggtactcaataagtatttgttgaatgaaggtgtaaatggctgtttgatggctaagacatgtcttgtctaggtttgtgactccgttacagttggagggtgaattgctgtatttaaaacgggtagagaactgtcagagatattacctgctacgaagatcgtcagatctattagatatggatgatgtttcattgccagaaacagcttcacctaaaaattagcagccacagaagcagggcttctgtagattatgatgtctaacagatcaactccatatatgatacatggttgcaaatttgagcaacataataatatttttgggtgcctattaactgttttaacactgtgaaaaagcacagtgggagataaaggaagaaacaatggctgtgctatatgcatgcttatcactgcagaaacaaagaccgagacacagagttctcattctcattcccaatgggaagcagcactaaacacagagttctgcatgtggacgtgctatcagggcttagccagtggtacctggtcatttctgaactcatgaaatagatgatgcattaatatactgaaatttgtttttctaaagccctcaaggattgttacttatcctttaaccgtggctgcctaaaactggcttaattggtttcgattgatttaacaacccttcttcacttagtttatcgttatttaggaaaaggtcaaattatgtggtcattgttgccatggttcattttggaatagcaaagtcacacattttcacaagttttctcattgacaaattaaataaatgtccatttttagcaaggtttctcattgtgaggagcccctcctctcctctaggctccaaaccacatttaatcctcctgcagaccagctaccaaatgtttatttctcctgagcttttgcagctactcttggtccaccttgagttaaaattagaatttctctggatctatcaagaaatatctctcttctatgccccagtgtctgttcaaccaacagtctcctcttttactctaattcattttcctgtttgtttgtttgtttgtttgtttgcttttccctaggaagtatgagcattcccttgtttaatattttcctcatgttacattttacactttcccatgttctctcactgaactgcactttgcatttattcagttaaatgtagattgcttccagtacatactgtgacataacatgtttaataactgaaatccagaacagatattatctgcaccaatgtagtgtcacattcaattacaagctcccagttcttttcctttttacattattgatttctaaaccaataaaatggatacttattcaaagccagaaggatttcaagaaatatattgaaataactgtcagataatcttggtgaactttgtaacaaaatcaattatacaatgttcgtaccaagttgcaaaggcaaggcacgctgccgctgtgactacctgcctaatgcactcaatgccaaatgacttttctcccagacacaacatgaaaagcctgttactcaaaaggtgctagtctaccaactcaacttttgctttccaaatataatgcttttcattgctgtctagcaaaaaggagctaaagagtgagaaagatgagttaaaaatgcaaaccaaaggaaacttaaagacccaaaggttcaaaaatcagtaggcatactaaaataacattatttctcttctttgctatgtttctctagaagtagtgaaataagtgagtaccttataccataatttcacatcccaggaatcaatggccaagtatagccatagaaagagttgcggtgaaaaaactgaggaatcaaatgagaaaagaaacattgtaataaaatgtgcatcgttgagtcatagggaaaatctgccttcaaaacttttcctagaaattataaaaactgcccattactttgaataacacattgtaattttaaaatacttcactacataaaaaggcaaattaaaagaatcctttgattgttccatccctatggagccttatgaatcccataatccttgagaggtatctttactggcatacttataaatacacaattaaaatatacaatgaaaatccagtaggtattcatcccttcacttgcgggactccagctatggcagtatgagagctctgtactcctcacctcttcacactatttcttctgcatgatacaactcttctacttcagccctacttctcttgttaagaatgtttactcaactgagaggtcacatcctcagtgagacttcttattgccaaaaaactccactgggctcccttatgcttatttcctccagaactttctgctttccttccctcagctttactgcagtaactactgaatgtcttcagtgctagagtgtgggcctcctgagggcaagagccatgtctcttctgttcacaacagcattgccagtaccttactcaatgcctatcacataacagaaaatatgtagatgtcaaattagtaaatgaaagtgtgaagtggatggtaaaaagtcatcatagtaaatcactaaaggggttcctttacctgttttgcatatatttgtgtttttaaggggtcatacagcctgaagatacactatatatatttgactacagataatgcatcaaagcattggatttttatggtagaagaacaacatctagatcatagtatgtggcaaaaagtgagagagatgggaaagaggccaaacgtagacagcatctgtaagccatagcaccagccgactgtacaatctcacaccttactataggagagaaagcaagtccacattatcttttcagtagtgcatttatactacaagtatcctgataagaaaagttgtcttgggccctgttattttctgaatgtatgtatacctcccaaaatttatatatggaaacctaatccccaatgtgatagcattaagggtgggggcctttgggaagtgattaggtcacaagggcagagccctcatggatgggattagggcccttataaaagaggccccagagagctgcctcgcctcttccaccataagaggttgcataaagaaggtgcccatctatgagaaactcctcagaagacacctaatctgctggacaccttgatcttgaagttccagcctccagaactttgagaaagaattgctgctgtttctaagccacccaatttgtgacattcttttattagcagtctgaggtgactaacaagccctaattcacttaaatggtaaatgaatgctttaaaatgtacactcaaccaacattttgagaatcatctaaaggataacatcatatagggactgatcaaagggttttatgatcctaatgaatgtgaaaccacaggctacaaaaattctcaagagcaaaaattcctgatcagattttatcagaatttactgggtagctttatattaagtacttcatcatcattaatataccttaggtttcttaaatgagctttaattttatttacaatagataacattttgttggcatctacaaattctgggaaatattagagaaagtaacatgaatacagctttaattaaataaagattcaaatataaataagtgtttgcaactggtataaaatgtcatctttgtggaagcattttatcagcttaacattttgctgctactaacatagatgaggcagaactaatatggccagaagcaaggagaaacatgcatggaataagtgctgtaaatttttttctagagctatatattccttagtcagcatgcaaggaaaatggtaaacaaacaaggatgctaaataagaaaaacttggaacgttcctcaatgtaccaaacagagtgtgaatatgccacttcattagagggtggagcattctaattttataaaataaagttaaatatactaatttcattttcaaatatttaacactttactataaaatacttttcctgatgtgaggactgattcacagaactgcataaggttatttataatgttttataaatattatttgaaatgatatataatggcctacttcttaaattatagagtaaatatatacagtaagtccaaaactatttttacaacatctgagaaacaaattttcccctgtagagtgtttacactgaggaaaaaacagctagattatagaagttaaaaatatacgaaaataggaaataatatgtactaattaaagtaagaaaaaaatgagccttacagtctcagaggctttagaattgaggagtagagaatgaagcttgcttctcaattagctttggaaaaataataaagaacaaaacagctctccaacacaaggctccatcttattgtacagaccctaccaaacgaagaatgatctttctggcccccaaatacaggaatctaccactctgcagcctgtcctcacttctcttctgccccactgccccacaaacacctttcgaatgcccacaaatgcctctcacctcagaaatccttttttgtcttgatactgcttcttaaatagaaatatcttgttttagtcaaacccattcatttcatctatcacacaacagaaggtttctatttttagaggtcaaaaatctcagtgataacccaataaaatcaaacctcttcacgggtaacaactgtatacacacacacacacacggacacgtaattttgcatgcatttcaaggtttacagagcaggtccaggtctgatgttaaatcaatgtgcatcagaatggctcgaatgccagtaaaatatggccagggtccattttgattggctgtagtgtgcattcacattgggaggtgcccaggaacaaccagttgataaatatttagaatagcactctctctggggacatggatcccaacctagatagtagcagtaggaaatcaatgcactgctacatctatggtgactatccatcatacaggaagctatgtatgatacatactgaatgcaatttatattttgcagccaggaagagtctcacttctaggtttaccactcacttgctgtgtgatacaaggacatttatttcttcctaaacttaaattttcttatctgtaaaatggagataaataatatttttgtcacaggattagataaagaataatatgaaaagtatctagtgtctggtaaaaaatggatcctcaccaaatagatgatataatgacaaggacaacaatgctgaaatgtttatcatttagataatcttaacagctcaaccctcccttttgctctacgatgcccgagttcaaaatacttttcttaaaatttatatttcattcacaatcatttctatttcaaaatccttcctttccctgaaaatcacagcttcatggcattcattaatgatgaggcaattcccaccaccatgacagccttggtcatgaactacttgcagattcagcttaataatgactgactgagaatgcatcagatgctaggcattatatacacagaaattttaggagatcacatgatgacaccctctaaacaggagcctgaggaacagcagcttcaagtgagaaacttttcacagggcaaataacatctaaaataccaaccagaatacacagtaatgcaataatggccaaatgaattttagttgtataatgttctctcttttcacattgttttcatagcacacatttccaggtttctataaaaatcagccaatgatgaaaagcaacatttgttatcttagtttatattagtaactcgatttcccctaggactgctatagatgtggaaggggtttgggactgaattaatgaagctatttggataacagctgaaataagatccaggaatgaaataatgtatctataaatctttttctgtgtctttagattctgcaatcccttgagctactttcttggtacctggaggagaaaatgattattttaattttaaaaagccagtaggtgtaaatatatgctgagccttagaaacaagccttaaatttttccaaagatacttcatatatttcagatacaaaaatgtaagattttttgcactgccaatcttctaataaagacttaaagaaaagagaacatttaaaaatgtttattcatcatccatttcttcagcaaatgtaaaggtagagtctacaatctataggatcctatatggggtggggttggcaagtgcttcagtcatggtctgtgccttcaaggacatcacgggctgggcatggagtgtggacttgcacaccaacaccgccgacgtgtggtgatggttaactgatcacttacagataacatgccatgacagctcataggataaagcattacatagagctgggttttgttaccgaagaatgaggtttgagttgacccctgaagatgggaaggagtggacacagagaggagaaagaacatcatatgcagtgggaacaaacatttctgaaggtaacaaattctgctgagaagtgactgatgtgaaactttgggaagtagtcgtgaaaaggcagattggtgttggattgcagattcatactctgggtcatgacggctgggctctatttaagaaaccctcattgtttttacagtgcctgacatatgctacctgctgaataaaaatgtgaggaatgaaatggccagagcttcacctcgaccacggacaggccataccagaggcagcaaggcacacaatagaatactctgcattcagagtctcctcctaataattagcatgaccttgggtatatgcagtatcttgtctgagaaggaatatttcaatctacacgatggacataataactatcttatctaacggggtgtttgtgaggttcaaatgcaatcatcactgttgaaatgtactggaataataacgacgttgtaactagcacagaagagaccagtatgacatctattaattattccaataagaggtggtgaccacctgaagtggaaatggggaggcagggtctggtgtcaggggtaaaggacagttcaaagttgaaggcaacagggccaggactccagggcatctctatctctgaaatctactctgataagtgctgtggacaaaaatcaagcagagcggtgggatggcgggttataagagggtgggcagagaaaccatcttagaggagacggcttagagctgagatttaaaggaatgaacgccttccaggcagaaagaacagaatgtacaaaggtcctgatgcaggagctcagtaacgatactgagtgaacagtctagaagctcatttggccacagcaccgtggccattgtcggggcagcagaacatgtgcttggagagatggccacaatcacatcaggacagtcccatgggcacagtggacttagggttttactgtgaatgtgatgggcaggcagatggtttgtgtctgaaaaatgttagaaggatcactctggctgctgtgtgagaatcagctgagaacattctagacattgaagactgataggaataggactgggcaggaggctgctgcctggaggcaccatgagggatgatggtgtttgaacaagagaatagaagtgagggatctgtgaagtgatcggattcaaggtctagctggaggtagcgtcagcaacgctgctgatggattagatgggggcctgtataagaaagacaggagtcagataggacttgaagatatttgtccttagcaactgagagagcagtggtgctgtgctctggggtaatggtctcttcagggaagggcaggtttggcaggaagtatttagagttctatttgggacatgtaatatttgagatgctagttccccatcctactatccaatgggtagctgaatatacaaggatggagaaagggagagaaatagggctggaaatatcaattttgtagtcatccatgtataatatcacagaaagccatgggcacgaatgacaataatttaaaaggtataataatagagaagagttttaaaatgagatatgggtgctcagttcttgggttgctgggaagatgaggaagagtcgtcagggcagccaaagagaagtggcccatgtggccggtgtgcattcggcggactctgatgtcccagaagtcatgaaagaaaatgaccatgtcatttggggatgtgaggattcttggagtcgttttgaagagtggtaggaggaaatgacaggctagagtgggaggtgagcatggagagatgctgagcctagatattttttgaggcatttttagtagaaaaagaaagagagaatttgggtagtagatggtaagtgtgaagaaatatggaaggttatttacgaaataatgtaacttgggagatgctacaacaagattctgtctgatacgaatgaattacccagtatacgtcctcttattaaatatttacaaaactctatatggtaggtgttatcactattttagggatgagaaaatggatttgcaagggagacacatggtccaagacagcatgggaactggtggagctgagaaggaattccagctcaactgaacactacagtggaagcttgagtacatatacaatgtcaccaccagagtacatttacaatgtcaataaaatcattttttaactcacatctgggaagcaagatagcaccagactttgggttaaaggaaaaatctccaaatctcttattagttgaaaaaccttgctttcctttgttttgtttgtttatttggttgtttgcttgttttataagttactgatggaagagaacatcaaatattcgccagatacatgtgcagaacatttcagagctagggaggtggccaggagaagtttcagaagggagagtgaagtgaatgggcccagacacttcaaggacatggaatttatttaactagaatgtctgagtaggaataaatgaaggcagaagaaagttgaaaaattttggatgatctagttaaaggctttgaagcaaagagtgaggatttggacctgcttctctttagagtgaaagctactctgagatcaaagccataggtgaaaagaaaggttgacagcagcatggagaattgattggaaaaaggttttgatggaggcagagagtgccaaaaagaaagagtggatgtcagctcattcttctggtaagtaattacaataatgaccctatgctagcactgttgaaaactaaagattagagtccattattacaatagagctatttttacacgagaaaaaatcccaaggtttaatcgaaactgttcatactgaaactatgacaagccaattgttcctagtacttttaataagaaatatacatgttataacaaaacctatcactacaactgggaataacacagagcatcccaccttactgatggcatatcagtagcatcaccttttacataaagaaattctgtctaattcacaaaatatactatttttagggaataataaaatattagttttgttgttgttgtttggcttttacagactgggtcttcccctgtctcccaggctggagtgcagtggcctgatcatagctcactgtagtctctaacccctaggctcaagagatcttcctgtctcagcctcccaaagtgctgagattacaggtttgagccaccaggactagctaaaacaccgcgattaaaggcacagaaaacatttttacttttattcccgattagttgtcctaactgaaattttaaaagaagtcattgaatatggaatctgagaaattagaacaacagtaaattagatcctagctcttcagtgggttggaaggtgcatacttcattcacctattaagctgacatttatttatacctacagactgactgaggcaacagaaagagaaaaagtgctttttgataatacactgaggctcaaaattttaaatcagagttgaaatcatcacttcacaaagtctgctggagtgctgaggccatctgtctccttgccctgactcttgtctccacgtcagtgacagtgtgtgtagctgactgtggatctgcagatgagagggtctttgcaatgggctggtcagagaaggtagaaggtgaaaggtgaaaggtgaaaggctgaaggaatgggggaggggaggggccattttcagtctccttttctgacattactgatcatttctgatcacaaaagtaagggactccttgggattgcaaaccactttatttaaagaacaaaataaaagtcatattaggatgaactaagtaatatatttacattctacaaaagcgctcaaaatacagtctttattcaaaagcccaagtcagatggattttctcactgaagccttgctgagtccctcaactggagttcaccctcagccctgagtcccccagaatacattgtacatatattttaggaaagaaacatgttctactttctaaatttctgttaaaacataatgtatttatgtatatataaatatatataaataaatatatttttataaattgtagataatctacagaatttctataatatagaaattgtataggtataattttatatatattgtgtgttcatatatacatgcatatctcacacaggaacaggaaaaggaacatccaggaaaaacttcttcccctttagtaggattcacttaaggagaactcaacgatttgatgcatttcagctgtttgaatataacttagctactcagtaatacatatgcaagtattttaattctttttgaatcagcccaagtaagccttaggttctgaattctgccttgtgtaaatgtcacctcatttatttactaggtgcaaataatacactgctaagcgatatgtgttggcttccaagccatcagttatgggtttaaatttggaatctagaatttaccaggtatgtaatttggagtaagttaatttaatttcctaggcataagttgcctcatttcttaaaatggggtctatgcctccttggattgttgagaaaatgacatgggatgatatttggcaagtgttcattaaatggtagcctttgttttcagcatcatcactgtgatcagctgaattgctgattttcactttaactacaggaaacttgagtggaaaagtctgagtcatttatgtactcattacttcagcggatcaattccaagtaacaaagctagggcctctgcttattgtttattgtcagttgcctgaaagggaaatgtagaggaggccacttcatgtaacaacacagataactccaaaataaaggaattttatttatttatccacatttattaaaatatttactttgtaagtataaaaatatttaaaaataattaaatataattttatttatgaagtgggcagatgtataaagaggaatgtgtgaaaatgtatagaaaaaggatttatcttataagtacctcatttttaatgagactctaaaagaaacactcaatctattctaagaaaaatatagtaacatgactatcaaagaatcatttattaaaagccttcagcttcaagtgggttactttttaaaataaatgattttatttccaattaatttggaggtctggctgggaatataaaagaatattattgtgttgcacaggcttagaaatcaaacaagtctggactgaaatcatgacttgctatttaccagctactcaaactttcttggggtcagtgtccttatttataaaatggaggcaatattagtatatatttaagcaaatgtctgtagagattacaggaagcaggtgaggtacctaaaactacctgagacacctagttcttcactttaagggttatctgctttgctaatttctctcacactataagcagctagaaaaatagagaaacaactgttttctgactgtctcagtctgttttgtgctgctataacagaactcctgacactgggtaaattaggaacagaaatgtattggctcacagctctggggactgggaggtccagtatcaaggtgctggcatctggcaaggtctttgtgttgtgtcatgacatagtgaaatgcatcacatggcagaatggcaagagagagcaaagggggctgaacttgccctttcataatgggtccactcctgagataacaaacttactctaggacatgaatccactcatgagggcagagccccgatggcttatcgcctcttaaaggtcccatctcttcacactgttacaatggcaattaaatttcaacatgagttttggaagggacaaacattcaaaccatagtggatatatagaagttatatatataaaatacatatgattggactgaggtaatgcgggactgtgatcccgacgtgaaggaaacctacaaagatttggccttgttagctatagcagaggaagggagacaccaaacaaagcctagaagtctcggtgaactggggaaccacaaatcgaagtttagggaggttaaggaaactagaattttcaggacacaatacctaaaagaagtgacttgcacagagagagttctggaaatttgcggatagactaccttgaatctctggctgaatattatttttccgtacatgcatggggttaacaattctcaaagctcacacggaggtgggatattttgcattcccaccagacagagtggagagaccttatggtacttgaggcatctggtagagttgccagaagactactgtcatcatggtggggctaaattacccatagcattatggctcttctggatgccccagcaaagcataaaagcaagtctcaaaaggaattgatgtcgactagctcaactgttgcctgcataaagacaaactttttttaaacagaatgctacaaaatccaccacctaatgtacaatgtctggaatctagtaaatcactatgaatcgtgcaaagaaacataaaaataggaaccacaaccaggagaaaaatcaatcaattaaaaaagatccagaaatgacagagataatgaaattcatagtcaagaatatttagctactattacaaacatgctccatatgtccaaggaagtagagggaaagaggatcatgatgaggagaaaagtgagtgttgaaagtctcaaatgtaatatatggagagaaaaaaataccatattttcaataaagatacactagagagattaacaattgattagataatgcagaagggaaaaaggcagtgaatgtgaagaaatagcaagagaacccattcataactcatctcaccaagaaaatagggccagagtatcagtgacctatgaagcaataccaagtggtccaacacaggagaaattggtgctgcccatccaagcaaggaaataacaaggggagataaagcaaagcttgagaatttttagaagttggaaggtaactaagagaaagcaagagtgggggctaagaatgatggaagacatgatcgatgccttcagtccttccttgatacccagagatgggccattacctccttaaaaagaagtttaaagtaatgaaactcaatttgacacaatactgaaaaatggagttgtattcatgcatatattgtacattttgctgtcactattttaggggatggtggcagaaaccaaaggaggctcttaatgcctttggcatcaacaatggtgtttccttggcatctacactaacacgccttaattaacctatcaccatcttaagtccttgtagattaaaattgggtgaaaatttttagaataagtatctacaaaaatataaagccttcccttgaagagcggacaactgtggaaatatacaaagaatggaaaaatccactaacaagtgacgtgacacagaaagacgaatacaggcacagggaagagacaatttgaacagaggcttatgaggacgtcgggtgtgggaagggcccactgcagggtaaagagaatcagcatggcagtatgatggaaacacacccatagcactctccacagcatcacagtcatctccatgtatgggccatggtggtcagtttgcctaaaactagcactgggaatgacagcttgttctcagcttagctgtggactcacactgagagattaggtttcataaagcagaaacgtacatcagcctcagaggacatgagtaaaaagtataaaaacagacccgcacctatacataggaataaaatgaagtatctgtaggtaccagttgatctgaaatggcccactccaacgaacagaaggtgcctgcctgcaagcctactttgagttgttttaaacattatgaacctgacagagcgagactccatctcaaaaaaaaaaaaaaattatgaacctgccaggatactgaataaatgctacttagtacaaatgtccaaatataggaaagtccattatatttttggaaacttaatgtcaccaatgacttcatttattaaaaaggcactctgcatgtgagataaagttgggtatttgaatgattttaagtcactaaatagttctgtgaaaacagttcagcagaattagctattagaataaaagcattgtccttgataatatgattctgaacattcaattggggattgcattatgattcagttttcgcactctaaaatccaacttcccttttagtttcctgtttaaaattataatttctaagactaagagccacaattgcccttctagccttttgcttttcatgataatttagaaaaaaaagaaattgagaaacatatggcaggtaatcatttgcaaacacacgactctttcaatgcctgccatgttcaacttcattttatagcatctatcttggcaatataaattgtgtttggctgcagaggtatgcagtgcagtacaatgaagaaaagcaatcgtgacaactgaaaaataaacaacaaatgtgtgtttgtgagggagagaatgtgtgtgtgtatatgtgtgtgtggtttagacggcaccagctctctgcttttccggctttcttccaaaggggaatggtgttattttcgttggtttccttgttcccttttacagcaaagcaatgccactggaggaaagacaattgccacatctcagagggttgccaaatgacctcaaaccagttcaaaaggagcgccctcaccagttccacaaatgaaagcaatttaatgcaggtggattgggtcaggaatatttactattataaaggccatgttttttgaaacaagagcctacattatattaatttttaaaagtggtagcacaggaagactgtaagattatttatgatggccgggtgcagtggctcacgcctgtaatcccagctctttgggaggccgaggcgggcagatcacaacatcaggagatcgagaccatcctggctaacacggtgaaaccccgtctctactaaaaaacacacaaaaagtagccaggcgttgtggcgggcgcttatagtcccagctacttcggaggctgaggcaggagaatggcgtgaacccgggaggcggagcttgcagtgagccgagatcgcgccactgcactccagcctgggcgacagagtgagaccctgtcaccaaaataaataaataaataaataaaaataaaaataaaaaagattatttatgatatagtgactattcagaatgaaacatgctagcatactcacgtttttgtaaactttgactttcatgcaacttccccaaaattctctcaaaagtaagttttctgggtttttaataaaaattatcaaaagtatctaagattcaaaactttgaaagtatataactaagccttcaaaatcaaatcaaatttacctaatgctttatttttcaatgggttttgataaaccaagttaaatatatttggaatacttcaactgtgcaatctacagtttaatgtattcagagacattctagctcaaataagtgcagtcacttgtcttactgttcaattaacattcaaattaaccatttaaatttcaacatattttgctttattgattatgtattttaagacaacataaaaatgaaagaaaacatgcttgatttggaggcaatacatgcaaattacccatggcagtcaatattggtaatagagaaacttaaaaagcatccagttgatttcaaataaatgtagaatactgctatatagtatactttgcataagtggtatatactgttgggaagtagggggagcaaaagaagcttatgtacatggagttaacacacacgaagagcaggtataaagaaatagctgcccattgtcccatttgatggaagtagcctttttccctagagaagaagcattaaaggagagtcagtctaaccaggattatttgtgtgttatctgttctgaaaatagcgcactcaggcaagatgatcaccaaaacctttccataaatatagtctgcaatgcaccattgtaagctgtcccgtttactattttgactcatattaaatgccaagagtatgtaaacacatgatcacttatattaatatccatgcataagctgcttaaaagattttagttcacaaaactcagatacgaaactgcaataagtctgaaaagcagtaaggcaggagagaaggagagtagccaattaagaaatggatagaaaaaaaatgaaaatgcatagtgagaaggggtattatactggctaaatgtacaaccccaggtcatggggttacctgcaccagagaattccagatgctagccctggctcatgcagcacagatggcagcccagtggtgaagagcctgcatccggcagtcagacttcctggctccacatcctgtctctgccaggtacttgatgtatggctttggtcaagtaagttaaactctctctgcctcagtttcctcatttgaataatggagatgagcatcgttcctccattataggcttgttatggagactaaagcagttaatgatcataaaggtcttagaactgtggtgggaacatagtaagcgctatgtgtctcctagccgaatgaccatcctgaccccctggattttttatttatgcaataaagataacaacacagacctcaaaaggcacttataatcaaattatttgagttaatatttgtacagcattgcccacagtgaccaaaatagagtaaacaaacagtaaacagtaacagaatcagtattgctttagtgaagaaacagctaagatttaataaacacctaccatgctgagcactttacattattaattcattttatccgctaacaaccatgtttgaggtagattttatcatcatctctactacaaagatgggaaattggaaacaggtaaataataatgataaatactactagtctgaggaaagctactagaattgaataaaaaattacttataaaccaaggcaatcaacctaattaattagcctttggactttttctcagttaattcccaattttgtgactgaattggtcaagatgatttgcagtgttggcacgtaatacatggccaattgttctaggagatgttctttatttatttatacatgtgagaattactgaacaccttggcagaggccactagctagttgtcttggtgatacatatttttctccttcttccttgttgagtaatgagatatttaaggtggtaaaatggccacccacaacactagatttccaagtctcccttgcagctagaagtatcattgactaatttctggctaatgaaatgttggcagaaggttaaaattattccttaaatgcaaagaatgaagctggctggtacgagtctttatcagcaattctcctttcttcttcttgcttgcactatggacttgatggctgatgtgccatagaatgtcttggaccaagaggtgaccttgggaaaatagccatgcactataagggcaatgaggcagagatcctggttctcagtggtgatacatggcggctttagactacctatgaccagacttctactacagagaaaaatgtacacttctgtcagctttaaaatcactggaatttttggactttgttcctagcaggtgaatacaattcatgctgatatgagcagccatatgaactgaacatcaagggcaaacaagatacatttgaagaaaataagaatgcaaataattaaatgcaataaagcattgcacatattaggtaataaatagcacagggtataatgagattgcccaggagaaaagtgtttattctgtctgcatgggtttcttagaggtgatgaagcttgaattgagtcttgaaaaatgagaaggcatttgattcaagaagacaggagtgaagcgacgggctgcagccattccaggcacagagaactcatggggaaaaagtcacagagagatatgagtaattagatatttctgaatcaaactgttattagtcattagggtcaaaaatatataatttcatacagaacggatggcatatttgattgaataagacattataaaaattatctggctcatttaaagaaatctacatattcttctccatgtaatatgcttaaaagtggttgacacttaagaaggcaaagaaaggggctggtgatgcggcttgctatcacaggctctctctcaaaatgtaggtgctcactaccccagcttgaccctgttaccgcgcacacttggttgaggttaacaaagcgcacttggagagaactttaaaggcaacctttagaaaagcacaaatctccaataaattaatattctcccatcatgataaaaacacataaaatatgcaagatggattttaatattcatgactcacatctttcaaaagattggtgagatatcaaatgtgatacgataacaaaaaagcactttgtagaggtgctcaaagtactttcagcattaatgaattcttataatacccttgtaagaaagaatggaggcagagattattcaccataacttacagatgagatcgaggtggaaggatgctgtcagaagatcagctggtgtaggtttatggtgctccgagccttcctgggagctggcttccctacaatgtctgcagtaggtgcacacgaactgtaggacctatggtcacaggcccacccccaggtcaacctttggttgtagcttcaccactgcagagggggcataatgacagcttacatagttgatttcaggaacttttggtagttctaattgactgctgagaattgcaccaatttttagcttggcatgagcaaaaagcaaacagcttgcttgggttgctaaccctgactgtaaagcttcggcacagtggaaagtctcacactgacaggccttggtgagagaaccacatttgctccttatctagtaacatttaaggctacggtggagtgaaacgacgaggatgaacgtaaaaggcctagtacattaagggatgaggagcatagcaccaactcatcatttttagttcccagaacttaatcaaggattcaggctttcacacagaactcccattggtcatttctttttaatcactaattataagagagatcacagattaaatttccaaagaggaaaaatccctgatgacttcctgtagtcaaggtattcacttcaacgcaatttattacggaaattgaactcttctgatgatgatgggtaaaaataaccttcaatttcccttttaggtgtgtagacatacaagcaatccccacttttctcagctttgaattttgttgctctcagggtttagctgtttaataaagacctggatgtcaacagttcgtaccagtgttcaaacagataaagacaatacattcagaataaggatatgtagaataaaacacagggatttccccaaatggtgatttgggtggtctggggaaattgttcttttcctgtaagtaaggaccatctcattattttgtgctaagcataatgtcaggcccactgtgcctgggaatatttacacattggggggaattattgttgctagtggagagtcttgcctgcaagttgtccaggttcttggtattttgaacaaagaattagacaaatgcacagcaaagcaaggaacaaatgaagcaaagaaagcagagatttattgaaagcaaaagtacactccacagtgtgggagtgggtgaagcagcagctcaagggccccagataacagaatctttttgggtccaaatacccccagaggtttcccattggccacttggtggacatctcatgtaaatacagtgttggcccgcaatcagcatccaggtcagcttggctgcagaaagcaaccaatcaggctgaagtgaagttacaaaggtcatactcctaaacaaacatctgatgggcggcgaaaagcaaccaatcagaggctaaagttacaaagttgcacttctatgcaaatgaagacttggcctgtaatcagtctgactggttgcagacagcaccaatcagaggctgaagtgaagatacaaagtgacactactatgcaaacgtactttcaatttcccatctgccacacagaaaaggttggggtttgcaaagggagtagcctatggtccttttgttactcaggtgtggaatgttggggtttttgtttcaatttagttctaggaagtcagtgtgaaacggccttaggatccctgcctccagaccctattctcccaactgattatctctttttctatatagcacccacgtagccatccagcaaacatatgctaaagatagtagactagagatggacagtctggcccatgacgatgtcattgaacaatttagttatccaactccaaagcctctctacctctgaactcagtttataatcttttgcatttttgggggtaatatccaggtttgttcaagtgtgctgtaaattttatgttaacaaaacctaccttccctttggaaatcatgtaagaaaactaaaaataaatgtttagtaaatatatatatatatcgatagatagatagatatactaaacatatatatatacgtatgtatatatacacattatatatatataaattttttttttctgagaccgtcttgctcagtcacgcaagcaggaatgcagttgcaccatctcagctcactgcaagttccacctcccaggttcaagtgattctcccatctcagcctcccaagtagctgggactacaggcatgcaccatcatgcctggctaatttttgtgtttttagtagatacgaggtttcaccatgttggccaggttggtctcgaactcctgacctcaggtgatccgcccaccttggcctcccaaagtgctggggttacaggtgtgccaccacacctggcctacattctttttattcctcctgggctcaagtgattctcttgactcagcctcccgagtagctgagattacaggcatgggccaccacttctggctaatttctgtatttttagtagagacagggtttcacagtattggtcaggctggtttcaaactcctgacctcaggtgatccaccggcctcggcctcccaaagtgctgggattacaggcctgagctaccgtgcccggcctttttttattttgtctaaaaagatgcagggctgggtccggtagctcaggcctgtaatcccagcactttgggaggctgaggtgggaggatcacttgaggccaggagttcaagacaaggctggccaatatggtgaaacctcatctctactaaaaacacaaaaattacccactggcgtggtggcatatgcctgtagtcccaactactagggaggctaaggtgggagaatcatttgaacctgggaggtggaggctgcagtgagccaagattgtgccactgtattcaaccctgggtgacagaggaagactctgtctcagaaaaaaaaaaaaaaaaaaaaaaaagatacaggatcataccacgtctatgttggctacttccaatctctttctttagttgattttgtattgatgttgcaacctcaagggaacaaacacaggacattctcatgacatctgacacaggaaagggattagcaatgaatgtgacaatgtgaatatcatcttaaagcagatccagcctagtgagttcttctcagcattctggacaccctactaaatatgatttcatgataccttacagatttatattttttctttataaaatagaaagtaaactttttaagactgaatggacttttcattttaaggtgcagttagtatataaaggtaagggaagggtacttccaaacacaattttaaagtcatactcttaaaaacgatattagcaataaccaaagagatcatttgtgaacatctcgtatacagctatgataaattgacactcacagaggcattacagggttataattttaaccacaaaacattcaatcaaggtaattatattctacttgtccacagaaataacttatcaataaagaagtaatgtagacagtcatgaacagcataaaagagaattccaaggagacaaaaattacgcaatatttctatgcgaaaaaattacccagagatgtcctcagccccaagtcgacaaccagcatggaggaccctataatgacctgtctcagtcagctacatcagggcaccatagttctggtaacatcactgcttaacataatccagttgactagccttgtagattctgtgcctataaaacaaccattggataacaattgagctatccaaaaaaatttatctataagtagagaatgtgctgatgagtaaacattagtatcttctccctttgttagttttggttcttattctactttaaccaaccagtattccaccttttaaacagagttatctgatgagtttgaccctcgtgattcagctctgcaaaggctgatgacttctgaattcaccagcgtttgggtttccacgcctaagagcttgaaaaaaaaagactttagaacatggggaccattctgtcaccagtgagaaaactaaactatcaagattaagtcatggagattttgaggtccctgtcacagcagcataacttgtagcctaattcacatatactacctcattcaatccttaaaaggtcctatgcaggtagcacaaaaacaaaaaaatagtaaagtccaaggtgatataagccagattgaaacaaacaaacaaacaaacaaacagtgaccacatatttaaaatgtggaaaaaagcctaaaataaaggaataacatctaagcaaaggcctgaaagaaaaccataatatgaaatatatttttagtcttccctgcaaagagccaaagagctttgggcagtagaattctgagatgggccagcagtcaggaaattaggaagttctcagatacaagacaaaaagttcaaggatgggtagaaattgaaagggaaagaaaagttataataaagcctccttttatactttctgacaagacaaaaattgacattcttttttagacaattgcaggttcaagtgtgtttacaagtatggttgctcatatgtgtggccagggtgggggtacttacgggacaaacagattcttctcattcattcatacttaagatatggatttcttggcacaaatagggtagtgagaagtgaaatattactacaaccctgtgtctgcgtctgaccatttctgcggctgtcaccatctcccagtaggacaattcattgttactttgcaccttcaaggtcgtattagagaagaggcaatagccaggaaggctagctaggccttaaaatattgatttattttatttataaaataaaatataagactttactttcttttttcttcataatttttttaagacagggtctcactctgtcacccaggctggagtgcagtggcacaatctctgctcattgcaatctctgcctccctggttcaagtgattctcatgcctcgccctccctagtagctgggactacaggtgtgcactaccacacccagttaagttttgcatttttagtagagacagattgcactgtgttcgccaggctggtctcaaattcctgacctcaaatgatccgcctcttccagcctcccaaagtgcagggattataggcacgaaccaccatgcccagccaagactgtacatttttcaaagtaaaatcaagtcaagatggaaaccaggaaggttgccatcctgtactgttaagagcaaaatgaaggtcttgaggccaaaaagtgagtgcagacactctaagactccaaagtctccagggtctggtagtttcactatcaggggccagaaatgcagaaataacccgatccttgggctaggaatgcgcaactgtctagtgccatggtgagggactgcagccgtcagtgtcactaacgtggaagggcgaaggcagtcaagagacggaaagagggtcttcaggaaatgatactgatgaagcaagaacagggggccaggattctagaggtgcagcaggatccaagtttcctgataaataaacccccatgaatgaatgttttgtcttggaaagcactgtatggtataaagactctacattcctgcattttgtcacaggcctctaaatccccaacctagagcacctggacagatctcacttcttcacatgcagattcctgaattcagtaaaaaagccaataggaatttaatgacctcatttcgtagtaatattcccaataccaaacacatccactaccatcgccgtgtctttttaagaaaataaatatgtgagtaaatacagaaacagatggatattttaaaaatacctgacggacaacaacagtgaaaaggatcggtcacagcaataacttaagtgtgggctaatctgtaatggacatatgtatcctaagaagacagtggcaaaatgtttctgatgtgaatttaaagtgtctgagtttgggggccttctctgtttctgctcctgatttatatgctgtctccagagcatgagggtacaaatgatttcttgagggcagaatcttcctctgctcccgcacacaaggctttgttaccgcagggctgctctagagcacagagcccctggcaggattcgtctcaggtgaaaagaacatcaaagctgttactttgaaaaagacgcactccagaaaacgcagcacagtatggattttgcaacagatctcacaccggggaaaaataaatccagctcaattatatttgggtcctgcctttacaaaggctcattaacctctaaatcattcaaaagatgtaaaggaagagcaaaacgaactacagctttccctgccagcttttttcaaggtgaaatattcttggtgtttgggtacctggaaaggaagaaatgtttaaggaactctggttctctgatattgacacagacaggaaattggatgtatttatctattttaaggaaactgtccagtgttatttattctcccccaccaccccacatcctatgaggtgagtcaagcaattattgaacctcaattcatggtcgttgaatactatgaaaaaatgctcaaatgtcacctgagactgtgggctatataatacaattgagtttctaataaaagtaaaagagaaattggcaaagcataggaaagccactagtgaagatctatatgaggcaataaagacagcagggacgatcctaaattaagaagagaaaaaagggaagaaaatcagaggccgtccacaatactgaagaatgtaagaactgaagatgattcagcagatgacctgaaatttcctctgtcttgaattttcaagaaacagaatgtgctctccacactcgtaagtgggtcagagggtgttcccactgcatggatgggcaagctggctggccgagagtttgtctcaaggtttggctccatcagacaaacaggtgcaccagcatttccctccaccattcccaagggcaccttcttagaaaatgaaatttcatgctcagtcaaactttagaaacatatgatttaaacatatgccagtctctttctacatatttgcagcttcgcaattcttcacctcccagtccctttcttaaaatagcttgtggttgaagctaaaatgtttagttgaatagtcatcttttcctcttcttatctagcctatagaaatctctcatgaggaaactgagcagccacaagaaaactgagttagtgacgatttataatgtgatattttgatgcctgagactattttcagaattacaagaaaattttccttttccaaacacacagtcttccagaaaaaaatctaccatggaccataaccaatgaacactggctgattcacgtcttgccagtcccactttaagaaaaagaaagagagacagggtatgtgaaaaagttataaagataaaaatatcttcggaggacataaggtaataatcaatttttttattcacatagggtaagaaatcttttctataaggtgaaaagtgtaagagacataaactgcccagagttacaggataattaatttacactgattattttactaaaacacaaacatagaaagtgcttgtgaaaaacattatttagcaaaaaaaatcaaataattataatgctttatgtacccttaaattagcagcaatccattacaaacaacagattttatattaagggtcccacatgagcttctaataacaaaggtcactttttactaagacataacttgtggctgctcaacagtagaattggaaagaaaggctcttctctgattttaccttcccaaactgatgcatgccaatgaaataaaacgttatcctgccaaatgcaagcaaccctgggggagcttttcattgattaagtaaggtcttattgtgattggctcacatcgtttcctagtatttcacaatgtgtgtctcccaaattttccaaatccttcctaattttcatccaaagtcacctcaagcttctagaaccagtggaactactgttctccatgacacccttcctgaatagcctacctcaagctcaccaggcccactcagccacatcataacttccatctaactggcccgctatcatttctctataggtaagccctatctcctcaatcaaggtcattgaaattaagtgaaaatgattgaaatgaccaaggcatcaggaacagtagtttacagttcttccacatgcatactgcaggaacacaatataaatttcatgataacaagtgatcctcttgggaggaaggaagacttggtatctgccaggaatatgagtggtatcagccccagaagaataacaaggtgacggtgaggacacacaagaccaatttcccaatattgtcaaggagagtgtggtctacaaatgaatagaaagcagcattttaaaaatgatatagactcaactaggaaatatcagattgtatctcatagaaagagtaaattgtttgctgaaatctttgtttcagctacatatatgtgtgtgctggatcatgatgtgaaatctatttcttactctgggacaaggtcagagaggtttaaaatgcactgctttaatttgtctcaaaatgtgttccacaaaaaagcagttccaccaatgtgacctgcagaaaagggctccaaagtcgatgatgttcaaaaatagtagattaaaccaaattaaacagatattttaaatgcctgaattaccagggcttttaaaacgttaatatgatcacaagtgttcaaggctagaaaatagtattgatgcaggatattttcttgaccccttcacaggacctgtgacagagctgtcccgtttactcagcccaccatgctaaacccctcacaggagggagcgtgcaagtgagtgcaggaacaagcctgctccttcggcaccagcaggaacaaactccaattactcacttgggcctgctgtggcgcaccccttgcgggaaggaacgtgtagggaagtgagtgcaagaaatggtcagctgctttagccccagcaggagcaaatcatgtgtaggccctgtggcagcatccaggtggggctgactgtgacccaaaggcctcagagggcatgttacaatgctctcttaggtctgctgtcagcagacaacagtgtgttatcagttcagcgggccctttgcctcatggagtgcagtggcttccctctgccagtgagggcaaaggggcattataacagccttttggggtacccgcacttgttgggtcctgaattcttgtctggtacactggaagaataaggttacctagacaaatggaaggatgattaatgcggacaattttattgagtgatgaaagaggccctcagcagagggggagctggaaaggggatgggaggggaaggtcactgtcccccgaagtcaggttgtctctcttcctttctcctccgaggccaggttgcctctctatgacattcagcagtggctcagaagccaattcacctctccccaatgtccagccatttcccctctctaccagctgagcctggggtctttataggcacaggatgggggtgaggcgagccataagtagtttggaaagggcagcattcaattggtaaaaagacattattcagaaagaagtactcgggagagagcgggtaagcaggggtagaagctctcactttgggccatgggttcaggctttttggcttaaaggtggggctttgccagggacctgccttgtctgccaagagtttctctgcctcctgtctccatcagcataaagctcattctaactatatggccatgaaacctagggcaggtcgaggaactagcctctctcccaccacactctgaaaaacagtggtcaaagccagtgctgctgaagacacccgcatcgcctctgcatttcctgtctgatttcccctctgacatatgaccgccctgcacagcaaagcccattctagattacaggggagtgctcagtaagcaagaaaaacactgagaacatctgggagaaaaaaataataagaaaatgcctgaaaatttggtttcatgttataaggaatggaaaattcatttcaattcagtccccaaatctaatataggtttctcaggggaccatttgtgaagtagatgtgttacaataaaaaatgttagtagatcaagaaaatactgaatggcctacactctagtgacactagtacaaaaggagaaaaaaaaaaaaaaggaaaagaaatgagatgaagtgtgtttaaatggcacttgcccaggtctggttattatcctcagcatctgttagttctgctgaactgcatttgccttggtactagtcactaccattaaatttagacagtctaaaataattgttatatgaaatacaaggtagataatttgttatttaagcatcagaaagtaaaagagcatcaggtagtaaaaataatcaaaacaattcataatattttctttatgaactcatgtactctttcttaataggaagccatgatttttattttttatatgaatgaaaacttgatacacatatattttctttctttgatagatattctctctcaccagtataaaaggaaatagcttaattgaaaaatcaggttaccaaaatgaaggacattaattcaactctggatttcaggtgatgcaaaaaaaaaaacaaaaaaattcaaaaaaagcacaaaaaggactctgaagataatttatgtacttttcagcaaaacacccacaacatgacttctagactctatggtaaatcaaagatggaaaaaaaataaaacctaaaaaaaaaaacaacaaaatgacttactcagctgtttccattgaaaaattacttcccattaggagatgaacaaaatgcagcatttggttaatccctggcagtggcttaccattctcttaatactttcttctgcatctacacagttcttagtcagcacatatctgatattttgccatattgctattttaattacaaaaagctaatcaagtgaaaactaatttaaataatcaagtaagtcaagggcaaattaatcctgattcgtctaatacaagtttattacatcaaaatccctatctactctcatcagagaatttgggattgtagttgaattttctttttaagcagcactatgagactaccaggaatacagacagaactactactgaatttcaacatcagagacagcaagcagaatatcatagatacagacagaactaacactgaatttcagcgtcagagacagcaagcataatatcatagttttataaaagtgatctcagaacattcatagtaaagtccatcaagcggaaaagaacagaacagaatggtctcaaagaattaaaatgttgactattaatctcaatgcccagaaaaacttgccttcatccaattctaaggagccacttttgaagtccatcataaaagccacattctgtaaatcttgacactggctcagtgctcagaaactttcagttaagaaaaaaaaaaaaaagagtcaagggaaacacaaatttggctaaagaaggaactaaaaccaaaacgtgataagtgattataaaaccattttcaataagatgcatagaataaggtacaatgtctaaagaatgcaaaaggatggaggagcccagggcaacttgcttctttaaaaccatttgatttcttccaaacagacaaaattcagggaaggaatagtggaaatgaggaaaatgagtcataaatatatgccttcacccacatctcatgtttccttggttagactaaaatattttaatatttacatccctatgtactgtatatatatttttgctatgccatcataatcaaaacaactaacacagcaatattggataccaatgacagtcaaaggccactgaataggccactgaataatggaattgtatccaatcgtccaaaagtaacattacttgatgtgttagtcagggttccctgaagggacagaactaataggattgatgtatatatgaaggggagcttatcaggagaactgactcacacgatcacaaggtgaaatcccacaataggccatctgcaagctgaggagcaaggaagtcagtctgactcctaaaacctcaaaagtagggaagctgacagtgcagccttcagtctgtagctgaaggcccaagagcccctggcaaatcacagatgtaagagtccaaaagttgaagaacttggagtctgatgttcaagggcaggaagcatccagcacgggagaaagatggaggccggaagactcagccagcctgctctttcattttctgctgctgctttattatggccacattggcagctgattagattgtgcccacccagattgagggtgagtctacctctcctagtccactgacttaaaagttaatctcttttggcaaccccctcacagacacacccaggaacaatactttgcatccttcaatccagttaagtcgacactcaatattaaccatcacccttgattagcagacaatgttctccccctttgcacacaggtggaacagagatggacatcacccatttggggtttgtaaagactccagaccatgtggccctatctgggagcctgatttgtctaagcatccccttgacgttaggcactcaggtcatctcaagcatttccccattgcaaatcacattttatgaatacctgtatacatcaatctttccatttctagttatttcttcatggaagaagtggaataaagaactgagttaacaggaatatttttaatcctcttgatacattttaatctggttaattaaaaaaaaactactggcaagccacattttgccagtattttgtttttcctaatctcggattaccttcctactctttttagtctattctcttctcctctgcctcttccccaccacacccctgtaccctgtgctccagctccaagaacccttcctgcacagaaaagacaggatggcactttgcccttccatgctagctcctggctttgtttcattttcacatgtagtgccttcatgcccttctcctcttgctctctaactctcctgattacccccaccgagaatggctcacttcctcatcaaggttactaagtgttctgttcatgcctcatttgtagcaagcacaatttacattttctagaaatataaatttgccaaaaagctgctccagctgaaagatggtctctaaaagtactgacaaaaatgcaactggtactgcaagaccagagcttagaaaatgcttctgcacataaaaggcactctaaaggaaatgcaattaatacaggggaaattcaaaagacatcttaaatggcctcaattatactctttcaggataatttataatctgctaatgataaaatgcagatggcggactatattaatttcaaaatgctctaccgcagttttactagatatttctgggactataatgcaaaaccaacccaagacacattcagaaagacttctcattccctccaactacagccaagttgaattccttactcttgttaggcatgcatactgtggatctcaggttttaatgttctctgtattttatcaacagcttgtcttccataataataatactttcagtcctctggtctcaacattttgttgcaactttgttgaaacttcttaatttaatatctgaattcatattaaagccttctatgtttctttgagattatttttttgctgggagtctgctgttttcagccacctatcagaaggtaactcatgaaatagagtataattgtcagggtgcgataagtttttggcatattttctatgtaactgataggaaatataatacaaggctgttaaataatgaaaattttaaaaaggaataccattaggaaggttttctgtttgggtgatggatgtgatctatcatatagttctaaataataaattcagttttctgtctcaacggttgttctcttctttctcctcaggaaatgttacacgctgagcctctgtctcccagaacagtgctcctgaatattgaaaacatgctgcccagatctttctttcttctttgacaaaggctacttatcttgtagagtgtaaaagaccaaagctttttgtttgtttgtttgcgtttttttttttttttttcttttggtttgtttttgagatggaatcccactctgtcgcccaggctggagagcagcggcacaaacttggctcactgcaatctccgcctcccgggtttaagcaattctcctgcctcatcctccagagtagctgggactacacttgtgcaccagcacgcctggctaattttttatttttagtagagacggggtttcaccatgttggccagtctggtcttgaactcctggcctgaaatgatccgcccgccttggccttccaaagggctgggattacaggtgtaagccaccgcgtccagctgcttgttcctcttctgccttcttcctattcctttctttcctcctcccgccttcatccaacacggtttgtggtccatgttacttgggactattataggcttcaaacgagtctcgtatgagcagtctctagtccatattccacccctgtagctagtgcgcccatgttaaagctctatagtgttcacattactcccctgttcatgaatgctcattagccttccactaactaccatattaaatcccatctccaccttggcattcagggccatccacataacgctaaccctaagcctagtcagagcccatttacttgtgtttgtacctcctattgtcctcccacactcacccttagagcccctctggaccaggctctgtgtcaaaaacaccaggtgatttgcttacctttaggcctttgccttgcctatctctatctattaaattctgccgatcttcttatcgtaaatactgttttctattgactaattatctatgagaatcacacagatactcatacgtgagcattgcttttctaggatgcaacagaacttaatgtttcttatagacctggccatatttttcttttttagtaagcttttctatatattagcaacacacacttggcaatttaattttaaaaataacatttgcaatacaatcaaaatctgatctacttagggacaagacctatagactgaaaactagaaagcactgctgagagaaattttcagaaagtcctaaataaaatggtaagcatgtcttttacaagtatctgaaaattcaatattgttcagatctccccaaacagatctatagttttaatgtaatttaaatgaacatctcaaaaggcagatttctttgtagaaattgacaagaaagttctaaatttcataagggaataaaaaggacctaaactagccaatataactttgaaaaagaaaacaaagttggagaacttctgctacttttctttgagttttattataagttacagtcatcaagaaagtgtggtattagcatcaggacagaggaagagatcaatggaacaggacaaacagtgcagaaacagacaaatactaatctgctaatttttggcaaaatgtaagtgtaattcagtggagaatggacaatattttcaacaagtggctctggatcaattaaattgatctgatctatggcttgtaccttgtaacatttttcatagtcctaaatatgaaggtctagaaggaaaccaagaagatttttgtgaccttgaactaggcaaatatttcttgaatgtaacaccaaaagaatgatccacaaaagaaacattgtataaattggactttatcaaaatttaaaacttctgctctttgaaagacatgtttagggaatgcaaagacaagcatgcacagactaagagaacatatttgaaaattataaatctgatgaagaacttgcatctagactctataaatacttttcaaaactcaataataagaaattaagctacccaataaaaaacaggcaaaagattcaagcagactaaattttaacaaataaaatatatggatggcaaataacaacaatcactgatggtcaatagtattagtcattcagaaaatgcttattaaaattctagcaaagcaaattatagtgacataaaaccaagctgtgtttgcctacaaatgatgggactagaggagtgaaaggaagggatggctgaatggcagtcggagactttcctggttctggacatgttcattatgatagcagtgatagtttcacaggtatttacagatatcaaaatatataaaagcatatacacttatagcactgtgtcaaactatacctcagtaaagctataaaaataatcatgctagcaatgatctccatttttcaagttagtaaaataattttcagaaaaggaaacgtctgcatgtgtgagagagaaaaaaagaccacattagcctaaaaacaaacaaacaaacaaaaaccctgcctaaatcagatggctgtcctgggactcaaggaactgtgctttaagaggggactttctcctgtagtcccagctactcgggaggctgaggcaggagaatggcgtgaacccgggaggtggagcttgcagtgagcctagatcgcgccactgtactccagcctgggcaacacagagagactccgtctcaaaaaaaaaaaaaaaaaaaaaaaaaaagaaaaagaggggactttctatcaggcagagataataaaaagcactagtcaaaggaagaggcaccttatgcagaaatcactgtcataatccttcctgtctataggcaaggatggctctggaccaccaccaccccctgcattctaatttgagagtagatacactactccaacccttagggtctttcttgggttctaagaacactggatgagaaaatctagctaggatcaggcacatctatagcaaagctcacaggtttatccacaaaggccagccatgggctgaccacgtgagcattctagggatgcgatccccagaaatctaggtcacagacaatcctctggaaggtacaaagaggacactggagcaggagatgtggtgtccagcccagtaccccctaggaaggccatgtatgtcactaaaggatgctcacttaatacaggcagaatctcatcttctcagaggtatagcagccctcccttatctgcggttttactttccacagtttcagttacctgcagtaaattgcggactgaaaatataaaatgaaaaatttacagaaataagcaatacataagtttggaagtgtgcagcactctgagtagcatgatgaaatctcacgccaccttgctctgtcctgcctatgatgggaatcatctttgtccggcgtatccaccctgtttctgcagcctgccattgttcattgacattgtctgctcctgacattgaaacttgaacatgctcacggctggatgatccagaatcacctgacgcagataatcctccttctgacctaacactacgtcacaatgcctgggccgttcaccttgctcaatccaatcaggtaggcattttatcaacgcaacataacaagaagtgcaggtatggtaaaataagatactttgctagagagaccacattaacataacttttattatccaacatattgttataattattctattttatgattattgttgttaatctcttaccgtgcctaattcataaattaagctttgtcataggtatgcatgtataggaaaaaacagtacagtttgtgctctgtatccacagattcaaccaaaagaaacaaaatgataaaaaagtaataaaacaattgaaaactacaagttgaagaaccaacacagtataaaaactatttgcattttatttatttattcattttgagacagagtctcactctgtcgcccaagctggagtgcagtggtgcaatgttagctcacagcaacctccacctcccaggttcaagcaattctccctgcctcagcctcctgactagctgggattacaggcacatgccaccatacctggctaatttcaccgcacctgaccttacatagcatttaaattgtattaggtaatccagagatgatgtaaaatatacggaaggatatgcgtaggttatgtaaaaatactgtaccaatttacatcaggaacttgagcatcagcagattttggtatcggtgaggagtcctggaaccagccacccgacagacactgaggcacgactgtttgtattgggtttggtactgcccaaagtttcaggcatccactggggatcttggaacctatctcccattgacaagagggaactactgtaaccaagaaactttgattaacaagagaaaactgtatggaaaaattcactaattaaatgataaacataatttacaatataataccttcataagacttttctaactcatatgcaaatagtaaaaatacacaaaacaagcaagaatgcaaaaaattttccctaaatcttaccaatttgcattaaagaaaaatttctggccgggtgcggtggctcatgcctgtaatcccagcactttgggaggccgaggcaggcggatcacaaggtaaggagttcgagaccagcctggccaatatggtgaaaccccatctctactaaaaatacaaaaatcagtggggcgtgatggtgggcacctgtagtcccagctactcgggaggctgaggcagaagaatcacttgaacccgggaggcagaggttgcagtgagccgagatcgtgccactgtactccagcctgggcgacagagcgagattctgtctcaaaaaaataaataaataaaaagaaaaatttctcataggactacagttcccctgggatattactattcatttataatctatcattttgcaagctgaataccttcttaacaatttcttaaagtgctatgaatgcctagacttctaagacagtgatgccagtgtctctaacttcctgtatatgccacgctagtttctgtatagaataggttatcaattttacgtctgtgttaaggacaggaatcacaggacatctcacttattaaacggcatctatggaattatgccaaacacatttatctataaagaatgctggtcctcactatttttcattaatcaaatgcaatgtgtaaccagttacaaagcctgtagtattaatagaagcttctaatctgtatagcatgctgctttcttttagctgaaataacatttaaaattcataaatattggaggtaaaaagaagaaaaaagattataatgtgtgctctggcttgtagcccgaggagaacagaaacaggggaaaaacaggtaatgctttccagcgatgagtgatgaaaaagaagcacaacaattccagtgactgtatgagaacagccagaaatcattcttctaaaaaatagttttaagcagaacaatgatctagaaaaggatcacaacacattgcaccgccctgagcagtcccataaagcagtgtgatgcctctataaagcaaagttccgtccaacagggctgtcagaggggaacatgagtgaaagggagggagcgccttgcacatttatatccatgctgcaatgatccccacatctctcatggtgcccagcgcacgtctcctcctgcacccacaaccaggaattaggctccacgttcacctgctctgcagctacaggccttatcctctaattaaaccaaccccactgctctagaagaatagccctgctcggtgactcactaacatttaagaatacacacatgtgaaactaagatgaaaatgagggcggagatgatttatgtgaaaggacatttaaagatgaataggttttgtgaggttgaggaagcctgcccctctagagacagaggaggcatttgctcaagtgtggaataccagctgttgaaatgttaagtcaaatgaagtagaaatgtaatgttatttaacaatggccgaaaaggaactcgctaattagtatttagcaaaaaaaggttttgagtggtcaacctgtgtatttgtttatttgtttgcttttgtttggagacggtcttgctctgtcctctggagggcagtggcactatctcggctctgcaacccccatctccatctcctgcctcagcctcctgagtagctgggactacaggtctgcgctaccatgcccggctaatttttttgtattttagtagtgacggtgtgtttcaccatgttgcccaggttggtctcgaactgccgacctcaggcaaacctcccaccttggcctcccaaagtgctaagattacaggtgtgagccaccatgcctggcctaatctgtggactttttgtgtgtagagtgtgactgttacaaatgggaatgccctaatctatatgttactgtggaattttcctatataacaaaagaaacttctaagaactgctaccatttggaatccagtaattgtatttatattgaaatatttattataatgaagtatagcagaaaggctagtgagttacagaacaatatcagaagcctatgtgccatctaaaattttcttttattttttaaattaaaatgatctcaccaagcttaatcatctctaaatctaaaattttctaccaagtttactaggacactagaggcctatttctccagaaaaaatggtaatactaatttttacatatattagaaactaaacattttccaggaatgtacaattactctggaaattccaaatctttatgtcaaaaaacctagaaaatctgccaaatgtaccatgtctaaacctaagtgggtattgctactaatggtatctttactctgtctttatatagaaacaggcttatttggaatttagggctcagaaatagacctacacatacatgacatggtcatttgattttcaacaaatgtatcatagtcatccaaataaaaaagtaacaactgcatatccatatagatatccatacctcacactatcataaaatttacatatgttggatcctaaacctaaatgtgaatgccaaaactatggagcttctggaaaaaaaaataggagaatatttcatgagttgggattaggcaaaggtttctttgacaggttagagaccacaatatcattaaaaagtaataaacttagaaattaaaacatctgttcataaaaaatatgaagaaaatgaattaccaaactccagactataagaaaatagttccaaaacatacacctgataaagtactgatatgtaataaatagatcaaagcttccagaacaatatatacatttcctaatgaacctaatttgaaagtgaacaaaatacaagaagagacatcacgaaaagaaaaatatgaatcactaaccagcacgtaagaaagcacataacattgtcagtgagtctgaatggaatgccagtgcacaggcaccagaatgaaagcctgacagcatccgaggcggcggagccaccgtaatgctcatgaagagtcagaggtttgaccttttgctatcaatgttgttataaatgttaatgcacaactatctgtcagcccagcaattccactgcaggacatttactcaagagaagtgaggccgagtgtggtggctcatgcctgtaatctcagcactttgggaggccgaggcaggcggatccccttaggtcaggggttcaagaccagcctggccaacatggtgaaaccccttctctactaaaatacaaaaattagccgggtgtggtggtgggcacctgtagtctcagctactcaggaggctgaaacaggagaactgcttgaacccaggtggcaagggttgcagtgagccagggtcatgccactgcactccagcctgggcaacagagcgagactctatctcaaaaaaaaaaaaaaaaaaaaaaaagagaaataaaagcatctgtttaaaagtggtttacacaacaaatgtttaccttgttgtataaatgctctattcaagagagtcaaaacctggagacggcccaggtgtccctctacagtagacaaaaatacttctcagccataaaaggcatgaacggttgctccacacaacagcatggaaaaatcgccaacatattttgctgaatggaagaagccttacaccagagtagagaccacatgactctttatatgaccctttagaaggcagaaattgtggtggaaaaaaaatcagaagtgtttctgcccctgctgggtggagggcttggaactgaccaggaaggagcatgacatcattctctggggggtgataatgctctgcagcctgacaggggctgaggctgtaccactatatctttgccacaactcataacattccaccggatataaaatctatctgaaaaactgaactatgaacatgtattgaacttgtttgtcatggtgttcatgttgaagtatttcgaggtgaagtatactcatgtctccaactcactttaaaactcattttaaaattcttcaaaaatgagacgaattggtaagtggatggagaaggatagatagatatttagccaacaaaggaaatagagtaaaaagttaattgcagagctctatcaaaaagcaatccttacccaacagcatgaagagattagtagacagatgctctagcttcccattctctggaagcacaattctatgagacattctccatagctcctcagatgcccaatgagactgtgccctaattgtcccctgcactataaactcaactacccactctttgtcagctttgctttattttccatctgactttcccaactcctcaatgtacttcccaagattactcccaaatgaaccacctgcacctaaaacagagtctttggttctgcttttacaggaacccaacaaagatgataatatagggaatagcatgcatatgtccaactgtgtcagaaatgaggagccaagctgatgagtggatctacagtgatgttctaggaaatttaaaatgtagaattccattttcgcattgtcaaatgcaaggtgtacaattttgagaattttaaataattgaatatataaaatgaaggctctgaaatatctgttgcgatagaggtaagagatctgacagcttgtatgttggcatcacaaaactattgtcagttgttacataaatggatggtaaagctggaatgcctggattggagtctcggccctgacgtgtgcttgttaatccctcctgcctgggtttccttgatctcttaagcaaaatgttgaaagagcagctggatcatggtaaatgctattgaagtgtgctattgtttttattattgcctggcaaacactaaggaagtctatccaaggaattgtaacagaaggaaaatgagggatctgactattatagagaaaagtaattaatttccacgaaacagtcagtaacttggctaaagcgagctttggattatttgtcaattctgaaataacagggatttttttttttttttcaaaacaagtaaatttaggacaaataagatgacgtacttcacaaagtaatgaaaaatgtatgggagccattgttcctcagggatgggaaaaatttgaccagtgtttgtgcaaatttggggaaaaaaagtcatggactagcactaaaggaatgagatctacctagactttgaggtttgtaaagggtcttaatgaggcaaacaccaactgtgttctttcttgattctgttcattacctcatttaattttcaatggtcttgccgtgaatatttgcatgagatatagaatatttttaaagcaagaatattaataacagtttttcattttaggctcattaaataaaaacgtcattttttcactaattcacatgacatttattgagatgtattaaaaaataaaagaaagactttgaagacaaaattgctcaaaggttaggggcaatctgctcttcttggagtaaaattcaagggccattataagaagtataagtcaaattatagtaccaatcaaagaataaaatatttttgatggaactgatataaaaaagttgcgtatccttgtaagacgaatttctttctctccctatctctgagtagctgcataaaccactaagtttttctagaagcaagtgataatgctttatcataggtacaggcttaaagaatgattaggtacacttaaagttgggtactcctatcaaaatccaagacagtgcattgcttctttcctttccaaattttttttttcagtcttgtggcccctaactagtaattaagagaactaaattaaagttcatactggctacttgaaatcttacttttaatattctttgcattatgcatggaacttgtctatggttttaaaatccaaggggaattatgacatttgtaaggcaaacccaggctttcatccatcattctaatctgttttacaaaaaaaaaaaaaaaaaaaaaaaaaatcaaagcagcatttgggggacaaaatgagtgacagaaaaatggcaaaaatgtgtcaacaatagtgagatttcagagatccaggagactagctactaacctcagcatctcccgagatactccattatcgctatttatgttattacagatgatataaatcttacgtacaatcattgtacactgaaaagtagcagaaggaacagaggtttgtgaccagaatctatgacgcagggaaaattaaaaatgcatgaaccattccatataggagggaattgaaaattatatgcaaaagagtatatgtacacccacagacatgctatataaaaatgaacaaaatttaaaagcttattgttacccattgttctgatacgtatttctgttttcttggaaggttctttgctggccggccagattcctaaattttatatcctgctgcactagtgagatatgtaagaggattccaaacactcaagtgtccaaactgagctgtgctgaagacttcaggctctccttcccgtaagatgagaggtcatcaggaagatgatgctctgtgataacaggattgaggcagaaaagctatttgtcacattcccttgtttggattttggttttggactagaaagaacactggcttcaaagtcagaaatcaagaaccaaagcccagttctaacgtgttttattagctgagggacttcaggtaaatcatttagcatttctttccttcagtttcttcagatatttaatgaaagaattagaccaattgatttcaaggttctcattttgtttcaagattctacagttataaatcataaataaatcaccagtaagtttgcgtttgtcaaacaattcaagttactaccactttacaagggcacatattaattttcttaaaaatttatcacatgttatgtaaaaaaataagacttctgaaatacttagacaaaccataaatgtgcaaatattctatttcactacctcatagacaagttttagctgattagcatgccctgatgaaaatacacacgatatgcaggtgtaggagttggatgaatatttttaattgtgtatctcctctgtaggccaaaactgttcatctactaatacattagccttaaggcatgtgccacttttagtgactcagttgttaaaactgcgttacagctgcatttgctcccaaaaaatattaaagtcctgtaagatttctattaatgaatccttttgatcttctattttacatcaggtaaaaggtttcaggagcttctccattgttacaacatctccttgtatctaggaggatatgggggaaaatagcaataaaataggtggggatgacattctgatactagagagcagttaaacgtgatgggggaagaaagcgacgatccaacagaatatcctcgagtaggaaaatgattttatcgcatgactgcctacctcattacaaagtgaaattcaccactatacattttcgtgtgagctttcatctgctgtacaggagagtggctccctgggtttcctataacagctgttcccatgaatctaccagatattttgtttccacttttacctttcttactctctgtctccatacccttctgagggatgagggtctgttgcctaactctttcattagttatttatttatatctgctctgggaaagaagattgtggaaaatgtgagagcaattcacacatcaacgttttaagatcccgtgtacaaatgggattgctccggaaaagcttcttcccacaggcactaattaaaaagcaggaagttcacttgagcagcatttttcttccgtttattttcctttgtaatagacatgctactttttactttaatttgaacattatccctctctgtccaaaaaaatacaaaaacaaaaaccaaacaaaatacagtaaaggaaggcagagtataacattaacaatttagaaaagatattattttcccctaataaattctactgcattcttggaaagcattaaaagtataacaggtcacacatccttgaaatattagatgaaggaatttgtgaagacagactattggaacctctgagaaattagctgggcctctacttccgtggtcattctgaagcatttttagatgctggtcacgattaatgctggaaacaacgttagtgacagttcttctgtgcttatcacatgcctttagttcaggaccgaaagaaggaaggaaggaccacaaatggtacacgaatgggctgcacagggtggtttaaaaggtaagaaaccaaagtgattgcttgtgtctcatttaagttaaatttaccacaaagttcatattcaataaatttaataagaaaggtaaataaaaacaatcacagtaagaattacatatgaaaataactatccattcattctattaacaaactaataaattattgaacatacactatgagtgattctgtcctagatactggagattttcatgatatactaagtatgtttcctgcaagagttgaggatgtcagaaccactgggatactgcggttgaatagacaccattgcctcttggtggtctgaggctggtaaatacacaggcaggaactacgcattgcaacagaaatacctccaaaggtccttatgaggatggtgcacacagaaaaaaacgtagggtcatggagaaactggaaggaggaggatagaagaaataggtgaaacaggctaagatttatccaccccaagttgggagatggtattccagtgggaaaaatttcactgctaaaactaaactagactagcaattctgtaagatgtaagagtgtgagtgatgagctgagggacagcctgagtggttgaaacgctgcttttctgatgatttggctgatggagtggccctaagcaagtttcttcaccgctccgtttcagattcctcctctgtcaaaccgggaaaatactcgtatctacagtaagagttgaaggattcaatgaaggatttaatatatgcaatgctgagaaaggtctgtggtgttcagtaaaaaatcagggtcttttagtttctttcgtagggctgcacacgcctgacacaggggatgtgaaacacagacctctcatcctacaagtcccagctgcacctgaccccagcagcctaactgcccctggcccatgactctaccccagcccattatcttcttcataatcacaatttataacttggctattgctacattacatggtgcatttgcctatgtgtatacttgcttattttgcatttattttcctcatatatgagccctaggaggatacggacttgcctgtatttggggactggaacatataaggtgttcaatgagttttgttaaatcattactgatgatgctgatgatagcctgccactacatagctcttcctttgtgctactcttctaagcattttaaatacactaatattcttaattctcacagcaactccaagaggcctgcctcattaagtgggtcctgttactgttttatagctgaggatattgaagtgcacaggataaaaaagaaaaccacctaaggacacagagtaagtgatagaactgagtgctgagctagcagtaggctctcaaaacatattcttagccattaagctgcctggttctaagtaactaaatgacagatcggagcggggtgctgcctggggccctggctagccagtaggcagaaatggaccccaagctacccagggatgggagatggggcagatattaagagaaatgaggcacatcctgtactagacaattttcctagaagcccagtggctgagctgtttcatctgcagccaagagtgatgttccattgtttcgcatgcactctgtgagccgcctgctgcctgttgcctgagccttactccttcatccagcagagccaggccggcccacaccccacactcttaccacagatggactgggtttgaatcatggctgttaaatgcccttcaacactagtcaagtgattactttctttatttcttcacctgcaaaatggggattataaggtacctacctcataggtttgtggtgagaactaaatgagttaatacagagaccaatgcctgggacaaatgtagctcctctaattaacaatttgaattccctggtcccttggtttagtccctgtttgtcatgtactttacaaaagtgacaggttcctattcttggaaatgaatctgtctatactcagaatcagaaaaaccaaaggaacaaaataaaaatggaggcataccagccaatgggtgcctcggtggtatctccatgaaatctaacccatcagaggcagataagcacagagtccaaggccttcctctccagaagaaagaggaagaaggggggcgtgtgggagtgtagagtgcaaccccctgaggggctgaacccacagaaacagcctaggggtgagataaggggtcctggcccctgaagacaccctggggaattgaatggcttggggatggggaaggagaaactggggggcagaggtgaatacctccccatttctcaatgcctggcacctgccattctgctgttcctttctttccaagatcaaaacaggacattggccatcctcctgggttgtgcttccaaggctctctttgatcactctcagccctccagcttccagctgaaactgacctctagtggcctgtacactggtcttactacagtcattgcccccagattcagaactcccgtctcatgtcctgattgctgtgcagtcagcatctccacggaccagcactctagattatagcaccgagtacaagatggaaaaccaaggaatttcaccaccagttagtgttagacaattcattgttctttagtggcttgagatttaaagtggcaactccataaaaactgacgaagccttccttggtgttgacctttgacacttgtgagcagccacatgtggagtgcgtcctggacattttcaggtatctattttgatgcagcttttttttttttttttaaattaaacagactttctcactaaattgctttgtcatggcctcagggagaatctggcctacaacactgtttactatttcaagtcatgtgtgaatttgatgccctcatttcctcttcttcatgcttgtcttacaccaatcaataaaggaaggaactgggtcatagtctcctggggatgactcccagagttcaaattctggctctgcctagctgtgtctttggaccagttagtttcttcatctctataatggaattgcaatattactttatagggttattgtgaggaataaataagataatgggtataaagtgcttggctggagcaaatgttcattgggtgtcagctattctcatcgtcacgatcagtctatgagatggagtccactgtacttggtacttggaaataagacgtgtttatagatctgtgctgacatgtcagttttcaagagccaccatatatcctgctctatgcgtaatctttgtaatttagagtaaatgttaaggaagagagggcaggaaggaataaaatgtaatgagcaatcattggacaaataaattgcatccactttttaagtgcattttgtatacagtttaaaggtagaattcctgaagttatacgattttaaaatacacttgagaaaggtgatgggctgtccaaagcaatgattttcttctaagaaatacttacacatatagaaaatttgtatctttatatttgctgatgtgaggctgctctacactttgttcccttccatcagcacgcaggaaataaataaaatttgcccacacgctaaataaaagtcagctgaatcccaagtccttgccgtcccctcaaccacacaaactcatgcacccataaatatcttctttttggttctgagtgcacacagaaccaaaggaatttgtattgaaacgtttgatttcacttaacctgcatatttctatttctatatatcttaactctgaagttaaaatacaattcttccaatgatatgaaacacagtattttaaaggtatcacacatcttgggttgttagcaagaatttatataatcatttatccaaatcactatctattttggcttcacaccagacttctaatcaattctatatccttgttcaaggcatgtttcttatttttcaccactagtcaggtattcattcccttgtgctttgttcttgttcatttaacacacaactagtcccattcataggaaacacatcctaatccaattggtgttttacaaattgaatcttcccaacagaaagtcattgtgtccctcctagttcagaaatactaactgcatgcacttgaagttaaatcaaaggataattactggtctaatattttggatcatcttaaatatagaaccatattgtgctacagctggagaaattctgagagtttttagataacttggaaattacacagcctaccgaggtgtctttccccaccctgtgaggctctactaaagagacaagggggacttcacagaaagtttaattcaaacttaattacacttgagcctgaaagttgattaatcggttacatttgcaagcagcagaaaccaactctggctgtcttatacatcttgtacaccttgttgtcttatacaccttggtaggatgttagcctccaagtctccctccaggcaagctgtcccagaggtcatagagcaggaagacttggaccaaattaaaatgcttgaatcacgtaactttttaaaacatagtttgagaaacaaaagggaacagaaaagaaaagtgagccaggggagaaggtgatttttgtttattgccttttatatctattatattcccagcaccacctacaacactggtccggtacatagcaggtactttatgaagatgtcctgaatagctataggatataagtatgcaacccttttgtaattattataagacaatgtcttggaaatcatagctaaaaacaaatcaaacgaaagaaacttagtctcatattctattgtcaaaaattcttccatgatggtatatgcaatagaagctgtactggtggatttctcccatgtacaggttagcacacaggtaacatatgacctacagagctgcagaggatctgtctgcttagtgctgaaggccaccacttgatatagaaagtagaagtggggtgtcagggtggtagggccactggtccacgggacatactgctggaatagcaagacttggacccctgcttctgtttatcctaaggaagtgactggtgctcctctgatgatgcaatgcaaatgtcctgcagtctaagggctgttgtctgacatccagtctcagtaaatatctgtgctgccccatctccatgaattctccatataaaggctatttgagaagccaggctgtgagtgctctccaccatgtagccttcactgacagaaaatctgctcaatgttttaattttaaaggtagattatggattcttttataattagttgtagaaaagatcctctggcaatatggtagttagaacacatctttgccacccttcgctctcaattaaatattcaactcttacctgctaagcagggggagcttggggcacatgactaagccttaaagtcctataaaagtatcagcagaggggcctattaagatttggagaggggtggaattagatgaataatctaataaagaataaacatccctgaagagccaagaaaattatgtagaatttaagttggttgaggctaggctagtgttttaagttggttgaggctaatttaatttaagttggttgaggctaggctagtgaaagaactgtgcagtcactagactcaaataagtataaagagccacaccgtctcgtggataataccaaataatagaggacccataagtaaatctaggactatatggtacttcattttggccaggtgatatattgatatgttgggagaaaggattatttaataaatggtaatgtcacagaaggccatctattcaaagaaatgaatttgggccccttcatcacaccacatatgaaaggaaatttcaggccaattaaaagttttaaatgtagtaaactaaaaaaatagcagatacatctgacatctagaggctcggagaccttgataatcgacaggtgactacatgaaaatatttgtatatgatgataccataaataaaaaacagcagacagtggaaactgatagactagaacaatatacatgcgactcccacagtagagaaaaggttactatctgccataaatacggcttacactgtgatttgaaaaccctacctaatgtatgggagcagagagaaatgctcaataaacagatgaaacaaaatttaagttacaagaatattttgttttggctaatcagactctgaacacaatgaaattccttttttttttttttgggaaaaggagtcctttcataaaatgaaagcaaaagtgtgaattattacagcctgaaattaaggaaataagtataaggacatatattttactcacacacaaaaaaataaataaatgcatataaatatgtatacccctattcactggattgctgtatatagtcacacacacacatgcacaggcactcacaccaaaatctagaaatatcagtaacaaatcaataggcaaatgtttaaatcaaagccattgcagcagagcatagaatattatgcagtcataaaaaatttttaaaaatagaactataaaaattacctttgagagaatggctataaatgattaagagaaacaaattcagaagaaaaaagaaaaaacttatttctatgtgtgagtgtgaatgcatgccagagatatcagaaaggattttcactaaaatggttagcaatgcttgtatcagcggtttctacctcaccttttttatattggttaagtgttatataatgagagtgcattgcattatttgtcacataaaatttaatttgaaagctatttcattgctaaaaggcactggtataactataacttatttttctcatttaaaaatattctatcaaaataacatagtgcttccaccaggtgtgtgtcaaaaaaagaaaaacaacaattactaatgcctatcatttaaaaggactttgatataattaagcgaaaaaaaaaataaaagcaaagcacgttctctttgtgccttccaactacaccaagaatacaacaaagacggcagaagtttgtctgtacatttaataaagaaaacaaattaaagagagtgctttgcactgggacatttgaatccagtggcagctgccagattaaaaaaataaataaagagccatagatcaagctgcagctgcgtgcctccaactcactccgcagcacaggcccaaagccattgtcagtgcccccggatgtgtgggtgtccttcatttctctttgaatgtggccaggcctcttgaaggagaacactaggtggcatgcctaccaagctctgaaacaccattaaccaccaggaaaaaatgcgattaggattctatttggagatcatattttcccctgtaggctaaggaggcattctctaacactgacaggctctgagtctctttagccagaaaatcaaaaagtttctgtgaagccactaggtaggacttttagaaatagagtcgctacatcctctaggctcctgggaaagaacctgtagctgaattatttttgtgggtcatccgtaaaatgttaattgtggattgtcaaacccttactgcagagaggactttcacagaaacagttctatttctgataaatcaattttagcagaagagtctcttttgacatgcttaattcaatgagcaaattgtaatgggcctatcccttaagacactggtgtttgtgtgtttgggagtgttcgctcagcaatcttggccctgatgctgggggaatttgaacctgacaggcccagaggatggggccagcccctttccctggcctatggctccggtgctccagacacacacacctgagctacctcccttaaaggttggaggtcaattaaatccctcaagtacctactaccaagctatttgtttaaagactattttggccatttttttgatcagtaggatattgtcacgtgctgccaaagtgctgcaggtggacatgtttgtgtgttctgaaggacttacatcatcctgcaatggtcagctttatgacacaaagaatgagtgataactcagtcttctcagttttgtgtcgtttgtggttttgtttgtgtttatttctttccctatctggggtaaaagcctcagtccctgattcagcagctttctatctaggtgtctgatttactgaattgcatcatctcttcctcatcagtgttttcgcttgtttgcttgtttgttttgagtcaagggctctccgtctgtcactgaggctgagtgcaagtggtgcgatcacagctcgcagcagcctcaaactcctggcctcgagcgatcctcccacctttgcctcttgggtagcagggactacaggtgtgtgccaccacacctgatgcctggctaatttttaaaatttttttcgtagagacggagtctcactatttcccaggctggtctcaaacttctggcttcaagcaacgctcctgcctcggcctctcgaagtgctgggattacaggtatcagccactgtgcctggcctcccttcagtcgtaattgcattttgaaaactgggcctgcagctctgtggataccacacatgttctatttgagcctatatttctctgctggccgaatttcttaggaacctgtgccaattgtttttcatctttgatcatcagcccgaaccatgctgtgtccacctgaggggacggtccagcatctctgtgccatggcagatggactgccggggctccacctggttttggaacctgcagtttgcaccatggctctcctgactgcagagccaccggcagctgctgtgtttcctcatttcctctaaccccagtctgtggggccttccccttcagcctgctgcagaacccatccctctggtcagttgaaaaatgtgggtaactgagttggaggtggcatgaggggactttctggaaaaggtctaaaagtctgtctagaggagcgtatacatgtgtgtaggtaagaatggcatcaagttgcacactgaaggtttatgccccttactatatgtcaacaacaaccaagaaaagaatcacctgccaaagtcagtcaccacctacttagttccctagagttgccactggctcaattcatgagcttatgtatgtgccaaggggaaaggcttcctcctccactcaggttttgaacattgtaaacactaccaagcagcaaacagatagagcctgaacgtgtgaaacttaaatatctatttagtgtttgcctcctcttcccatttttttttcctttgacagaaaaattgtagtaaggggacagtgctttttgttatcttattactgtgtgtgtgtgtgtgtgtgtgtgtgtgtgtgtgtgtgtatgtgtgtagcaaagtctacatcctagaaatgtatgctgcatgccacagctgggggcctttgtgatacatgtgataggtgaaattcattgtaaaggcatatttgaggtgatttttccttattgtaattctctgtgaattgggagctgcactgaggaagtgacaaggatgaaatgatggttactatgatcagcctgttttccccaactaaacattttcacttggttgaaagctaccagagactacagtcaataataacttaatcgtacatttaaacttaaagagcgtaattgcattgtgtgtaactcaaagaaaaaatgcttgaggggatggatacctcattctgcatcctgtgcttatttcacattgcatgcctgaatcaaaacacatcatgtaccacagaaatatgaacacctcctatgtacccacaaaaattacaaatgaaaaaagaaagtcatcaggtctcgaatatactataaacatatgtgtttacagtctcttcaaacatataccaagaaccttatttaaatctcaccaaaaagaattgtcggctcacaggacaagcttaagagctgtccactgtgataatgtgacaatcccaaacgaatcttttctcctcctttttcatatttctcccttccccacattgactgaatgatatgttgtcggttccttttgttccaatcaggtagttttcaaaatttcatggcaggggaactgagttaaccaatatatacatagcctaattagctttcaagttggctttatggggcaaacaagcaagtgcgttatacaacagggaacagtgggctcccctccctcctgtatctcaatgactgggcacacaaatgcatccccatatattaactggacaacacaacagccccagctagaccagagatggtagacaccaaagaggacatcagggaacaggcaaaatccaaataacatgattctagtttaaactggattggcctcattctcaggtgaaaatgggtttacacaatgcatccctgcaacatttgtaagcttatttgttcctttacaccacgtttcattcagaaagaacgtgaaacagcccataacaatacaagcaagtgaagatatctgtggaggggagtgggctgaccgaggaacagaagggtaggaaatgttgacccagtcgggggtgacgttccagtcccaggtcagttcccgaagtttcatgtgcttgctagaggcaggacacctatttgtttctaagctttccagcaagcataggaaagggaagtgggattaattacataaatcacacaaaccatttgcatatttctttgctatttctggtactgaaaccaaagaatacaagtggatgcttggtgttaccaacatctgcacatgagctgaataaggatgatggtcatattggctctggaaccacttacagcttctacttcagatcatggatttccacacatagtaggtattaaatgctttttgaatttaacgggacaagggaaggtaatcagaaaatgaagaaagaaaaagagaaataaatgcataaagagggtcaggcttggacaaatattgatacagtgttgtacaagaaccatagaatccaacatggtacacctgagatacaaaataacaacagcaaccacaaagagaaacatggggagaatcagggaaagaaactaagaatcataagtaggaatcactaagtgggaatcaggtcctaagcaaattgctttatgtgcatttgattatttattccatcattgcttgtcagcttccaactatccctgcccaagagaaaagtgcacagacacactcagatttaggggtaggaaagaagttgagaataagaaaagaggttctgaaaggttaaggatcttgccaaaggtcacacatctaggaagaggaacttggttaccttatcaaaaacaggaaatccattctcagtttgataatgagtcagatattgtactgactcattatcccagaatacgtacaaacattctcagtgatctgagttcctggcgtattttcttttgtattgcaatctcacaaataatgtgtagagaaagaaaggaactgcatgcaaagtgtgttctttttacacacttactttgcatccaccagtttctaccctggacaaagacaggggttggagctgttatttgctgtattactgctgtactagtcccttcttgatggttccaaatacactacactctagtcattaaacacagatgttgcctggagatcaaacgctacacttaaaatcatgattcaatctgcgtttacatttagaatgggtgtaaacttgaggagaaatgctgtattcagagatattgaagacagacttataaaatataatagaattttatattacacgtagaagcgtctcagcctgaggacaagtggcactagctgtagttgccgtcaggctgaagcctgtctatggaactgggcggggtggatctaccgggagtctactgacatgggacagtgaagaaccacctgggaaaacatcactgtgtgtcaggagggtgtgcaggcacccaagcatcatgcaaatctaacacttcagtctgaaacatgggatggcaagttactaccactcagccagctcccatgggctcatcccaggatcctcgcaggagtacacgggaatttttctcttattaaaacatgtgtgggcatacctcattttattgcacttttactttattgtaatttgcagatattgccctttttacaaattgatgttctgtggcaagcctgcttagagcaagtctattggcaccatttttccaacagcatatgctcattttgtatctctttgtcacactgtcttaaatttaaccttcaactaaataactattgtattatttgaaacgttcaagtaaactaaagttttgtgaaaactgcttttcacctacttctaaaatgcattattattgggtcatttctgacacctttttttcttttttttggtgcttttctgccgatttgaagaaataatgataaaaaagaatttctataaatgtaaggatacttggttaatgtatatttgcatttcattgacaaaataacattttccataaccatgtggtctcaagcagataaattcctgtccagaagcacggtgctaccttcagcatttaaatgtcgggaggcccaatgtgttctcacattgagaaccacatgcattggaaggtggctgctattcagatagggaagatgtaagaggatggagaacaaatgaggtcctaaggagacatgtaaggcattgggagttcttctgctgcagaacccaggctgcagcccaaagggatctgagagacagctgctactgacagggaactcacacaggccacatggagctgtttccctgccatcatcatcttctggtgggtctccttgctgacccactctgaggataagaaggtgaaggagatgtccttgacagatggcagcctatgaagtaggtttctctgtgtaagaaagtcacctcccctcctgtcttggtatggggagggaaagactgtaagcctctctgtcttataaaaatcaaagatttgtggttccaaaattatatgccaaagtatacatcttggaaggaattcaatatggtgataaaactataagttgggaaactaacaaccttggtcctagtcccagatctgatctgtcactgctgactgcatgaccaaggcaaggcctgtctgatttctaagctttgggctcaatagccataaaactttactaacacttgaattgccgcagtatgccgcccctcgatccctaccatacaccccatttatgcaatagccaagtaacttttttccagctctttcttcctagttttagaaaaatacacttactagttctaaaaatccaaacaggtgcacctgactgccccagggagaatcccctgaactagtgctatctaagagaattttctgttgacaggaatgctctaaactacaatgaatgcagcagcctctagttgcaactgcccagtgagtccttgaaatgtggccactgtggctgataatctgactatttaattttctttaattttaattcatgaaaatttaaaaagtcatatgtgcctagtggctgacatattggacagtacagctctgtatcaacttttgctaattaatgtacatatccaggatcttgtactttatttgtccttttaatcaatcaaatccaatattcaataagcaaaaattactgattgcataataggaggcttcacaaaagggcagagtctagtgaagtaaaaaacatccactgtcctctctttctcttgattacttccaacatttacaaatttgggcttgccccgctgatatggtttggctgtgtccccacccaattattagttcccataatccccatgtttcacaggagggacctggtgggaggtaactgaatcatgtgggcgatttcacccatgctagtctcatgatagggattaagttctcatgagatctgatggttttataaggggcttctcccttcgtgcggttctcatttcttctctctcttgctgccctgtgtagaaggacatgttgcttccccttccaccatgatcgtaagtttcctgagacctccctagccatgcggaactgtgagtcagtcaaacctgttttctttattatgacccggtctccggtatttcttcatagcagcgtgagaacggactaatacatccagcctcctttgacttcccttttgctgatccccactgaagttaaagatgcacatttcacacgtgctttaaagattctgaaatctgcatgtttggagtaggccaggcaatattgagaagttttggtatataaacctttgagaaacttaaagtaaaccaattttctccactttttaacaatacgagtttctgtctcctaaatgaagcatttatttcaaaactcttatacacaaaactgtaatcttaaaataagggtgggggggtgctcctgactgccttggtcttctgttctgactaatcttaacaaagaaagcctcatctaataaagacaaaagtggcatcgttatgaaacttgtattgggctctgcttctgaacatatatactggcattttcctagatttgtgatattatttagtacatatttcacctaaactatgtattccacagcacattttccaatgttatggatattttttctaaactcatcttaattttccaagttcaatacaatgcatagccatttgaaaataaatgcccactaaatttcaagctgtacaaggtaaacttactttttccccccactaaatgataaacttgagtaatatatagaacctaacatttgtgccaattcactctcctgccaccccttcttcaaaatcataggtttccaaataaaggaaacaaaaacttacggctgaataccctgctccaaattaaacataaagtaatcaaagtcattattaaatgtttttcatgttgtcgaaggaaacaaaacaacaggaaggacaagagtttaggtcaagaggttccggtgttatctgcgtccttcattataagtgatttcaaaatctttttccctccaggaaaaactagtgagtaacagcttagtctaaatgacagcagctctgtggtacgaagggtccacatttcagctaattttcagctcttcttatcctgataccatgagatggaatttaatagatggctggaacatctataacatgacatttaccaaaggatgtgtcagcggcatccatggcctcaacaaagatggagccttcaaaacataaatcaaagaaaaatataagaacatcttagaagaaaaggatgacagtgatcctgcacatttaaaatattttaaatgccttagggactctacggagcaagtagtgttaaaaataatgatgtaccaactaaagatatttagctccctgttaagagaagaggctatgtagcagaaggagaaaatctttagattttttttttcaaaacatgtggtttgagagcccacctcacactgttcctttggtaattctcttattctctgtgaaccttgtatagttttcttgggtgtaaaatagtcacaggattcccaaccttacccaattcacatggttattaaatcaataaagacaatgtgtgtgaaaatactttttgagctgtaaaaggctctacatgaaaagcttatgtaatagaatattaaattggaggtttcaattaaagccagatacaagagatactataaaccaaaagaggtgctgattgcctatgtgaatttacaaatctaaacatcactgacataatttttttaacagactttttttttttttagcagttttaggctcaaagccaaatcaagcagaaagtacatccttttcttccaaacatgggctattttgaaacatctcatgaacatcatatttatagattggtttgttggagtgagtggagataatgtttgaaggtgagataatgtttgaaggtgatttctttgtggaagaaaagggcttctatggaaagactccactcagagagcttgatatggctcttctagagttaaggagaaacagtgatatgatttggatctgtgtccccacccaaatctcatgttcaattgtaatctccagtgttggaggtggggcatggtgggaggtggttggatcctgggagcagtttctcatgagtggcttagcgccatccctctggtgctgttcttgggatggtgagtgagctttcacaagatccgtttgtttaaaagtgcgtagcacctcctcctcactctggacaggtaaaacatctcacatctcctttgccttctgcggtgactggaagcttcctgaggtctctgtagaagcataagccactatgcttcctgtacaggctggagaaccatcagccaattaaactccttttctttgaaaattacccagtgtcaggtacttctttacagtaaggcaagaaaggactaatacagagagtgagttcaggtctgacccgagtcccacttgataatgttaaaggctagctactttgttggtatagttatattgggtttagtctgtgatcccagagtttgttaaaacaaaatatgtatgagaatgcccaatggaaaatgaaaaagagctgcactgaaaccactttagtttctacccaagatgtcctggaagaccaaggagactccaacagagaaaatcggggtggataacagtgaaaaaccagcagctgagaaagaagtgatcaccggaggaggaacatcagtatatgcttggaggtgaagcagacatttcctctggtgacctctaaacaacttgtacaggagccaatgagataaagtttgcttttcacacttcctacacttgacagcttaaacatatcccatgacagtgtcagctgagtgagaactttcctgtgccctcttgctaagctcctaaattgtgcttcaacactgaggtatcagaaacagaagagagcaaaatggcagtgcaggggagcaagttcaaggtggggaaggacggaggatgccccccaccccaatatacaccacccctccagcaagtgcccagcctaatgcaggcccagcaggagtacatggcaagctttttatttgtttagttggttgttttcaagagactggacactactatgtactgaaataaagctgtaattgaaacttaaagttatccatttggccctgggagaaaatctattaatataacatgacatttaccaaagaatgtgtcagcagcatccatggcctcaacaaaaatgctatctgccaggaggacatggaaactcctttagaggagacaaaagaatcctcagtaaaaggaaccaccaccagatacagcgtgatgggttgtgcagttgaagctacaaaaggtttgtcttggacattaatatggtttggctgtgtccccacccaaatctcatcttaaattgtaactcccacaattcccacgtcataagaggaacccagtgagaggtgcttgaactatgggggtgggtttttcctgcactgttctcatgatagtgaatgagtctcatgagatctgatcattttaaaaagaggagttccctgcaaactctctttttgcctgccaccatccatgtaagacatgacttgctccttcgtgcctctcaccttccaccagaagtgtgaggcctccccagccgtgtggaactgtaaatccaataaacctctttcttttgtaaattgctcagtctcgggtatgtctttatcagcagacatacagatataccgggagctgctttacaaaaatcaccagtaggcatgaaatttccagtggctcaacacgtcccactatgaccaaccctggtgataagctcagtgtctgacacagtggctgccacacctgctcgctctgaattgtcatttccaaccctgcctcttcattctccaacctgaacaccaacatcattccacaaagaaggccctgtgtacactctgccttttccttctctacagtcagtactggatcaatgtccacataggccctatccacaacccaacagcaatctcctggtcctacttaagagcacattcaccttctaatttcaggatcttctttcatagtcttgccatacctttcgtggctccaacgctgttctttgaaaagaaaacttctttgaggcaggagaatactctgtccctttttaatgcttgaatcgtaagtttaatacagaaggaaagccctaggaagtaaatcattgtagctgctttaaacatttgaagagcctacaggtggaacattccttagatttcgtttttttttttttttttaaataacaaaactagaagaatgggtggaaacatttaggtcagataactttctctcaagctctttaacaatgaaaacagttttgtgaaaagcaatgattattcctttactcaaagtgctctagcaaagtcagatgactacaaagcaagcatgtaagagtaattatcttctataggagggaattgagattagacgactgcaaagttgattcctattctaattatcttctataggagggaattgagattagacgactgcagagttgattcctactctaattaccttctataggagggaattgagattagacgactgcaaagttgattcctattctaattatcttctataggagggaattgagattagatgactgcaaagttgattcctattctaattatattctataggagggaattgagattagacaactgcaaagttgattcctattctaattatcttctataggagggaattgagattagacaactgcaaagttgattcctattctaagtatcttatatcggagggaattgagactagacaactgcaaagttgattcctattctaattatcttctataggagggaattgagattagatgactgcaaagttgattcctattctaagattatggataggccaaggtatacaatgactattatatcattcattatcatagtcattgtataccttggcctaccattaatttacttcatgaaacatcttaaacatcaaataataataatagtaataagaataaaaatatctactatgtggcaggcactatgctaagcaccaaagtatggtccctgccccaaggaaatgaatctaataagggagcccagaacagggggacccaaataatcaagacttaattttttggtcatactccatttatttcatgaactctgtttatgcaaagtttatatttttatgataacattgaacaatagacatattatgtcatattggtttatactgacctttacctaaagtactttaaataaaaatatcctattcagagacaaagacaaagagcatggttctcatttgtttgtagcacattatgggaggagtagagttcatttctccatgagatactactgctagctttaaattatggccatctctgagtgtacgcttattagcatggcattctaaattaatatgaaattctgtatgcacaactgaagattcataacacattaaaaaaaatagggtcattctgacactagacagaaatataattctttgaaactagccgtgggagaacccgtagttcaatcataccaacaaatgactgaagggttttaatcatactcagagattcaagtggaccatgcccagtgcatgccatagactctggcatcagtgagtatcgtgccctacaacaaacccacttggctaactagtcactttacaaatcatattctatgagcatttcccttttaattttcataatttcctttttcccagtacgcaatactcttccattttcttttcagcaagggaaaactccatgtttcacttctaatccagttctagaatcttaatccccactttagaaaacagagtccagtgaattttactcttttcagggaaagcctgcagagtaagtgtcaactctccctcaaccttataagaaaactaatgtgactcaatgtgagtgctttcagcaagaatctgagctcaagttccccagattaaactctcagtttggtttctttctcgccgggtgacccaagtaaagtcaattaacctctccgtttcccacccggctttactgatgcatttacgcaggtagctggatattcccagatggaagagcatgcacgcatacattcataatgcaaactcatatcacagtactggtctgtactggcttgcctcattctgaagcagtattttcagggagactcccctgccccgcacattttatcactgtaagataagatatttgtttcttataaagcatcaacaaaggatctactatgtaggaagaaaaggctactaaattctatttatgtttccccagtgagatttttgagccattcgcttcttaagcacataaattaacccactgccctacagatgtagtttttacttccacaagtcttgataaagctcctcagtgctcaaacggataatatgtcagtttcactctgcagagactcaggaaggtacatctatgtgtagaaacaggcactggagaaaagtagcatttcacacacaaaaacagtttcaaggctagccaagtctagtacaggcaaagtgatacaaatagggcatagaacagcagggtttccacgcaggaaagaaactgatgagttcaggaaagtgggctaaaacggtgatgcatttacaaatgtgatagtcgctgatcattgccaacccaacgtgcttctcaccctctgtccttgctcataggaatccgattttttttggagatggaatgggcccagactaggggataaaataggactggtctaagccaatcatggcaattctgtttccatgtggcaaacacttgcttttcaacatgcttcgttactatcactggccatatggcccagttataaatgatgagctgtaaggagaggcctattaggaggcttctaagaattatctttttccattttgtttatttttatgtatttatttatttttgagacggagcctcactctgtcacccaagctggagtgcaatagtgccatcttggctcactgaaacctctgcctcctgggttcaagtgattctcctgcctcagcctcctgagtagctgggattataggcacatgccaccacagccagctaatttttgtatttttagtagagacaggttttcaccatgttggtgaggctcgtctcgaactcctgacttcaagtgatccaccgacctcggcctcccaaagtgctgggattacaggtgtgagccaccgtgcccggccagaattatctgttttatatagaagagacaggcactgctgtgtccgttgttatcctgccttgcacacagaattgatgccttgatgctctgttctatgccatgaaggacagtggctagtaaagctagaaacagccccgtcagtgtgtgagtcaacaagaatgtcctgatgggtttatctgctgtgtgagtgcctgatccctgccaggagacagcatcacgaaccaataaacaaaccaaccaagtttttaaacatgatacatacatgtaactacaacgtaaaatgaaacaataagacatatgaaaaacgttctttagagaaccttattttttcttttatgctttgtaggtactttaggttgagttttctcaaacccttctatgtagtatcaagaaatatttctcttataaatattttaaaaatgtatcatcctgcacaatgaataagattgtagatcacttaaccaatttccaattatctaaattaatgactgcatgtcactactaactgacagactttgtaaaacttttaatatcttttacataaaaagtaagtaatactggcttggtgtacctcattgccataatgatatgcatatgtgaaattagaaaaagcactatacaaatatcataacaattaaatatttaggtaaagtctgagcttagctcatgatttatggtaagcattcaataaattatagggatttttttttttttttttttttttttttttagataaggtctcgctctgtcactcaggctggaatgtggtggcatgatcatggctcactgcacccttgactttccaggctcaatggatccacctgcctcggtctcccaagttgttgggcctacaggcacatgctaccacgcccagctaatttttttttttctattttttgtagaagcaggttctcactataatagtagtcactccttatagtatacatacaacaaaaccatgtactttggaagtaatgcaataagtaacatgttttaaaatatatacacatactttttcagagtaatatgcttttaacttcctgcccacaattttgagaatttcaaactagcagcatgggtcaagcgcatggctgggtatcaaaacaaaaacactgagacactctacacaacaaaatgcaaagcgacatctggtatgttcccatctctccagggtcctcatgatgctgagcttttgagcattctaaaggtacacttggggaacttgcgtctgcaagaccgacttctttttctgtctccctttttcttaaagagtagtgagtaaaatcattaccaaacaaacaaaaaacagttatcattacagagggatctctattaaagaagcaatgaaaggctagcactactgtgggctggatgaaaataaatagctggattgaaaagtcaatgaattaccaacattgacccacatttctctagactttaattaactgacatcatcccaatgaataacatatgataaataaaatcttaattctaaaatactaggcaaaggacaaaggctctcaacgtacgcatttctgtgatacagaagagtaacaacgaattggctaaaattgccggcagctcagctagataccattttacttatttcagatcaatgctgggtttctccctcttcgccaaagctgaatgtgcatcactctggcttttgcccaggtccccacatagactttgataaaatacttactcagtccaccttcggctatcactcctccctgaactcgtctatcccctccatcctcttcttctcttaactatgcctctgctccatgagaccctcagctaaacattggaggagtctttgagagccattcaaatgatctgatgttttcctaaaaattagtgtctttgaacaaatgaagcttttgtgacctatacatgtgtgtcctatggccatttgtaggagttggttctaggaaggctgctgaaaatccattcaccaaaggctgattcactggctggccaacttacctaatcgtttactcaaaagttctaaaatttgattatttatgaactgcacagtgtggtctttggtgtcctgagctcttcaggtcccctcctggcccctcagtgtacaactgcctggagctgttgcagaagggagcaggggcataaacaatgaacatccctaaaatgctcctaggaagagaagaggtgttcacctataacctgaaaagtcctggaaattcaatataaaatacagaagatcctaaaagctgattaaaagaaacatatttttggtaaaccaacaaacaaagaaaatgatttggaaaatgttttttaaatctggagtaacagaaaaacaactaaaatagagattagaaagaaatcggtataagccaagagttcccatatggaattttgaagtttaggttatatttataacaatagacgtacaagtatattaaagaagaaaacgttcttaagaagatgaattcacctgtatttcataactttcaacaaattgatcattcattaaaatctgctaagaaattattgaccattttgagaataatcaaatacagaatacaataaaaatacttgaataaattccaaaagaatgtttcaaaacaatattattccttatattagtaaatgtggtaaaaatcagcaaaatagtaagtgagaaaattcaatggtatccatatgaggtgtgtgttggtggaaaagaacatttacgggtttgaaacccaggcatgaattatcaaaatgagtctcaagaaaatggcagtagcagcatttacttacaattttaaattccttctactggctgatactgatgccctgaaatggtttcgatcaaccgtctttaaggagacccctttacatatatattgtatacagtatgcaaattctaaatgtaaactatcaagaataatacatgtataaaaaataaatcatcaaaattttaagttctttatggtaatccttttttatatgtttatttttatatgtttactatgttttttatatgtttatttttaccttaacctggctcttttggaagtattagctttggtaaaagggaaaaagaggaaaatattttaacctttctcacttctctatcgactggctctttgcgaggtgagtgtgcatcatttgtgtgtggatgagagcccgtgataaggaccaaggagaacacaagcaaagagagtgggcgtgaaaaggagatgaagtaagaagcgtccacaaggccaagagaaatctcgtggcagaacagatggtggcgtgaagggcgacagtgaacacgggggccaccctggctttggtagatgccagacatgcattgtgttctgcacactttccaccctggagcttatgaatccacacagaaaccagcttcgctgtagatttaacactgtaacgcgatgcaaaacagaatgcatggtggccggttccactctcactgtcgggacatccaaaacatgccctacaaatactgtcaataacataaaataatgcgtaatgcctcctccactgtgctttcaaagcactgaaacgcctgataaccaaatctacaataagcaaagaggggatatcacacacttaggcaaaaacaccccatgtgaaaactagaaagtaagcttaggtctattctaagacttgaatttcttacataaatgtgagagtaattttgataacaagagaggtaagaagactcctggccaacaattaatctgtaacaaatattaagcttaggaatgattttacatttagactgtatttcttaataaatttcctcacataaattgtgcctaatctataaactaattttaaacaaaatccatcatgccaggcactttacatcttactctatttattgcaccatttctcatcagaaaccttttagctttaatgctattccatggcagagtatctcattagagtggcaaagataaagttctttttgagataaagtaattacggtgattgtagcggggagggggtcacccaaagttcttggctacagtaatctcctggcttctgattcattttaagaccaataaactgagtacaaacaaaaagatgttaatggtggataactctggttacctagagtttgtcctggagggattagcaattcataaccttaatcagaactagagtcctggagaattttgctcccaggaaaatatttcaagaccagatgctgtatgtgctctcagctcacttctatgtcaattctatcttctaattattattaaagtcaatcaagtatttcactctataaaaagccttactatattttaagccaattttctgttccaaagactagtcagttacttcctatcccaggggctttgctttcttgaggaggcacaagtcagttgaaatatgggctatggccaagacaatgatagtagcaagggacaggactcctcagccatgatcagaaagagtactgttaggatttagtgagaagccttcaggggaaggaggaggcttggttttcaaatcatgccaagggacagacttaccattgccatggagtcaaattaaccttaccagcccagtcaaaataattaaaaattaatacagtctctgataaagtttgttgatataaattggtgctagggaaatatttcaaggaaacaatgacatgagttattttaaattattaatttcattggtcaggaacccaatcagaattaaatatgcacatataaaacaacctcccttgtgtgttcaactctgtctcatttctgcatggacctcagtggatgacttttgaagaagcagatgaaaagtgaatgcttgccaattagctattgttcaccgttttccagtaagcattcatatttctaaaggattatagtctagtccaaactctgatcaaggtcaccatgcaagaaagaggatattctgatatggagatgaagaaaatttgagtccgggttggttctcaacttacctatgaggtcaggtgaaaacttcagacatcagttccccatgcctaacatcaggacaaaattaactatccatttcctttacaatttgttagagtatcatattaaatgtgaaacatgattaaactggagcatcacatttgaaaagcaactcattattattacatgtaaattttaaatagcattcaggaaatgttagaattaagaacaaatcaccaataaaaactttagaagattaccatttagactcatgatatgagtggatctcgttgcaaactgatttttccaaatgagaaaaaatacaattatactttcaaaaataacccaggtggctaaccaggttccagttttcctccttaggtataaaaatcttgctgaagttcacataaaccacatgctgctcacctataactagtcagccacacaagatcctatattgtatttttgttcttgatcagagacaattatgtaagttatcgatccttataaagttctagaaaatgaaacctcagaattgcctattattcacacagcaatctttacacttggcaaagtttagcacctactccattattgcaaagcctaaatttgctggtgaatcagtagtgtgactggtcggctgatccacagaaatattatttgtaggtgttactgaatgtgtatttttgttattgaaaaattgaaacatctgatcttctcctatggactagctacactagatctagttactgtactaaaatatggattatataagttatctttgatttaattgtccctaaatccataagcatatttttttcaagagtatgtttcagttatattttaagtacaagggaagtagttagaaaatagaacactgattactagatttgtatagtgaggactatatcctagtaaaggccagggctatggaaaaatacaaagcagatttttcactcctggcttcgatatttatgaactgtgtaactttgggctcattacttaacctcatggagtctctttgtaaaaacactggatgagaattggagaaaaatagaaatacaagaatataaggataaggaaggaaatcagtacactgtagtgaagccatcataattgctatgcttcatttcattatatgatgccagacagaatttctaaagggtatgaattcatggagtcaacatagaaaatttcgaatacaaatgctatttattcagcattacttgattcgtgtctttctatggacaaggcactttgtgaggtgttaaacataaactagagacccaagctgaaagttatctgatcttataacaaggcttacaggctcttcgaacatagacaagtaaggacactttggtagaatgaagggcaggaagtgaatgatacctgcaatactggagttgacattttggcccctcaggtaggaaatgaagagaggagaggccaacagctctagaaaaacttcagagaagggtcaatgatatgcagagcagaaaacagtgcttggggaagaaacagcatgaatttaaatatcaaaggtggagcatctctgggaactgagaaaaatcccaggtggtcacatgactgggctttggagatagaggtggagccgagactacaaaacacagggattgaacatccctcccaggatgctgggcctggggagcagggtggcatgacatcatcacagagcctcagcctgagatggaaatgctcacagcctcttgatgcagagcagtagaggtaggggtggttttacttctctgaaatcagttagccaaagcctagattgatttcatacatgagtatatataaatatatatacatacatacataaaatagtaatattaatagaataacaataaagaattttacatttctaaatatttatgttctggctactgttctaagtactcttcgtaaatgagctaatctgcacaaaaggaaatagatactattgtaccattgaatagatattaccaagttggcataggtaagagcaaaggaagtcaggattctaatggggcagactggctctggctaactgatttcagagaagtaaaaccacccctacctctactgctctgcatcaagaggctgtgagcatttcttaggctcacaggtcatcacctctcagccaagccttactgttcctgaggattacgacatgtcaggctctggtaagtacctactattaatgtaccatttagtccccacaacactctattttggcttgttatgtttaggccaatgctacaggttggttttctttctgtttttctatttttttcccacacaaagcatattattaaatgagaaatcccatgtaaaattccagattgatgatttcttttgattaaaaagaaaacaatacagccatactgagtttccctctcacctcttgccagcaactggcagaagcgacttttcaacatgaattccacctcacccttccactactgtcctcaccgccccctactgcccacatctaacctaacttctcatcacctgagtgatcactgtggacatatgagtatgtgacatctatcgtaattatatctgtgtgttaaaaaaaaaaaaagctgaaaagctaaaggagttaaatgtttagattagacagtccaggttcaacctccaagtccacactcataagttcctcttttcttgggcaaatgccttaatctctttaagccttattatcctcacatctaaaatagggttactaataatgcttaactgagagtgttcttatgaaataattaaaccagataatgcctgaaaagaatttagcttggaattcaatattcatttttattgccatttttaccaagaataccaggaagttggtataaataggtcatatatgccacctaaagcaatcaggacttaggcacagattggggtagatgaggttgtgtcttgtgttgagaaagccagaggagaggagcaagtggaagcaacccctcttggggacattgggcctgcagcatgctgcccggcaggagagctgcccaagaactgtcccagaaagagccccgtgggcatcattcttgtgtggctttgactctataaatgaatttctctagacagctgaaatgttcatcaaagtgaaacactgaatcacagctttctgtaattccaccattttctcaggcctgagaagatggatccatgatttctcctttattaggtggatcttttgagttctttcacaggccccgtaacacccattctacagggctgccaccttgaccctggcccacagctcctcatctgcgaaccagatgaaatgcgccttaattagcctcttgtctttcacctgtccccatcttcaagtctaatggcaaactgtcctcagcatgaactgtcctcaatagcgtttgacacatcaccctggtttatacaattttgctgtggtttccgtcagcttgcagaatagaatctgaacatgccagtcatcactggggttcctggctggtgcctggggtatttacccacacttgcacacctgactgcccccagcactgtgtccttgacacccccgtgtctgtgttctctccaccgcggggactggacacgctcggcctgcatgccctctattgcaaccacatcacatccagccaaatcccttggagccaccgagccggaacctgacactttctatcggggtcagcaaacctgttctctaaagaaccagtgagtatgtattgcaggctttgtaggccacccagtctgtttcccagctactccactctgcacttaaagcaggaaaggagctgtaggcaacatgtacagaaatgggtggggctggctctccattaaactttatttatggacatgagaatgtaaatttcatgggtcacataatgttattcatcttttgatttttcccaaccatttaaagccataaaaaccaactttgcgtcaggggctgcacagaaacaagcagtggccacagcagacttcagttgactgacccttgctttatatgcatactgtttgctgatccatactctttttttactttttaaaattaaggtataacgtacatttggtgcaccaatcttaacgcaacagcccagtgaatgttgacttttgtatataaccatgctaccatcacacagatcaagatacaaaacatttttagcagcctaaggttcctaaatggtcccttctaatcacaccgtaacagaagcccaacctctttttgctgccaaagcactctccatacttcctttcataggcctggataaagtaatggggaaacaaccctgtgtaatctaaactttcacagagcagaaagaaatccagaagacaaaggcgcataaacgaaacttcggctatcattaactatcacaaccacagaagagaatgtcttttcttttcaaagacgggtgatacatcattagaaaaactgaaaggcaatgtgttagtacacattcattttcctggcagtctcatgctgacactgcatttccttacctgggtcaaggtgagcgttgcctgcctgcaggtgctgcactgtaccctgagttttcccggctgcactctttgacaggggcctttgcaatacacataaaagctgttgtagattgatctacctgctggagaagaaaaagcagaagaagtggctaataatgctgcatctaaattgagacaagaaactctttaaaagcttgttagaggcaaattttaaaactcagtcttcaggaacattttgaaacattactggaataaatattccaatgggaatacaacaatttaatttagaaaatctaactttatgctccaagagtgaaatcttttctctctcttgccaacagccctgtgacttactcagcaaagtaagcagcctactgccaagagaatcgggcaagtgtatctgcaacacagtaaaatcagaggcactctttgccgaggaagtttgaaaagatgacaggaattctttcaggatgctcctgaattctatctcgtgcttccagacacagttttgaagactgcagatttttcctcataatatctacagagaaaaaccagcccatttatcgtgatataaatgatatgatcacagtttgctgggcttctagggttgactttctaactcacagtcacacataaaataagaaaagaggccaacgctgaggaactttcagagaccaagcagctatgtgcagaaatggatggtttgcatttcatttatgatctctctacctaggcaaacaccattcaaataatacattttcaagagtaaaaggtgaacaaacaactaattcaatagttcaatctcagatcatttctctcaactgtcaccatatagggacactctgtaaactagggaaatttaatcaatttatacttccatatctgttaagaattaactttattcagaagcacttaccagaaatacaaccttcttcctgaatttctaaattttgaaaattactaaatagttttttcttttaatccttacctgggtggataatataacagatcatgacataaaagtttctttgaaattttactatgatcatcagaggcacctagagataatatatttttttttaacatttggaatgaaaatcttcagcctcacaaatgcatatgatctattaaaaacaactagaacaaaaataatgaaaaaaatgagattctaaagtcctttgcagcttcatttcccgaatttacaaaaagagcttttgcagacatattggattatcatttgtttagctatctttcctaatactgtaggtgacaatactttgcaaaatctgaagcacaacaaagatgtaaagtttcatggttttatcatttgtttgcaatatattttataattattactctataaagattaatatttagtttccagtgggaaatggaagataaaatgtaaatacatgtttatattgatgtgaaagtactattttctgacacttctgtgtaactttaatgccctaatgtacaacatattcaagtacataaatatgacattgctgttagcaaacataataatgacataaaatgtttcacatgtaatatacatgcagcatagaaccatgtattaatgttatagaaatatttgtaacaactgactgaaatatctgtaatatgtaagtaaatgttaatggaaatatttgtaacataaatatttgcaacatgcagagtatcaaaagatcacaagaactgtgacaattctgacgtgcactaagaagtgcatagaagaagaagtgcttagaagaagaacctttactgttaaaacctttatcagcaacaggaacaaatccaatttcacaatttttataaccttttgtaaaggtcaaacaataaaaagaaaaaaggaggaagaaaaggaacaggaaaagcaaaagctttgaaaggggagtcagggctgcaaatacgctagcattgttgaaagagcatattagcaagagttttacaatattaaaagaagcatctcagaaattgcaggaaactaagtgactcttctctctcccttaaggcaatagtgatgtttgcaatattgtttcagctaatgatatatcaacgcagaatctgaaagctaaggaacttttccacctccgaatgctactaccttcgctgaagtccttcagaagttattcagaaaatactgtatgccaatgtctgtgccctagaagcatacaagatgacatgcaatctattacacacactgctttccagacccagccacaagttggggattaacagccagtctaaggaagatcaaggtcaggccagtcgtggctgcagcgcttttcaagctgttggctccacttggtcaagcagctggggcatcaggtaaatcttgagagcccctccagaacggcttccctatttatttagctacataacacaattaaaagttggcaaggttttctgtgtcatgctgtgacctggacaggcatgaaaacaaataacaccccgacaatcttctgggcaaggttcccatcggcctggctgaagggcctaaagtagaaactcttgaatatggagtcataactcttagaggaatggcaaggcaattccaaaaatgacctgagaaacctttcttgtggtatgtagctgtctctagtcaatagcatgaatctcaccctttcacttgttcttggaccttaaaatcctttctctctcctaatcaactcttctgtatggcagcttcttgattatcccaataactaaagtagcttatgtttgtgttcataagagtttcctctttttgtatagtaagttttgaaacatagagagatatttcaaaaattgtacaaatcacatccttcattgtaattcatcacttgcagatatttcgccacgtttgggttccctgtgcgcgtgtgtgtgcatatagctgtgtacacatatactacatgtataaactatttggttgaaggatctgtaacacagtttctgacatcatgctacttcacctctaaattcttcaacatcctaaaactagggatgtttttcatataaaaccatttagctttttaagtgatttggttattttgtagttctattcatagactaatcaggtatattttaagtaggcattacagaaaatgacagtggtttgcaagctaataaaagatgacaataaaaaatattggggattctctcgtcaaaccaatttaggtggtgctaagtgaagccacattaaacaagtcccctgaccataccccttctcagagctgagtgactctgtaaaaatgaaaggatgaagcacaggacatctcaaacttctcctgaccatagatgccttcctggaatgctgcatcgtgtgacactgtacttctcagaaaaaaacaatttagaaaaaaatatcagatgaaggattcaatccacttgtagggcttgatttatagaaagtgaaactgctcatgtttataaacccagatttaccaaattctcctggatatctgcctacggccaagttctttcctccaacccaaaacatcaacgaactcatataattactttgtcatgtgccaggaggttaagtctacttatgtaatgattttgcaaataaagtatgttaattttattcagaagttttgttttttttttttcctgcagagaagttaaaaagaaaagtgtactgagttcagggcccttttaaagcgtgagtcaccgtggccattcagaggtccactggctttctaccattccttagcctaagaagtccatcttcttcttcttttttttttttcttttttcttttttgagatggagtctcgctgtgttgcccagactggagtggaatggtacaatctcggctcactgcaacttcctcctcttgggttcaagtgattctcctgcctcaacctcctgagtagctggaactacaggcgtgcaccaccacacccagctaattttggtatttttagtagagacagggtttcaccatgttggcctggatggtcttgatctcttgacctcatgatctgcccacctcagcctctcaaagtgctgggattacatgcatgagccaccacgcccggccaagtccatcttcttctttagttttctctcacgctttgcctaacagaaccctcagtcaaatcttctcttttcctttcttttcttggtcaaaaaagttgctgaaataacaatgtttacaacatattgaatagagccaatatttgaaaatagtatattttatttgcttgggattttttagaaaccagtataatctttacagttatcatttttcttttatgtattttagataataggcttaagggttgaagacaggatacttaggaagagtcgttctgattctaatggaaacttttcattaacctgagaagtttccatcactagttgtcactgagaatttaattgctgggataatttgttttctaggtggggagagagtaagatttaacatatttcttaccttggtaaaatactgttcagtatcaacatattgtaacagagcaaaacagcaggaacaggacggattttaagtgatatttatcacatgagctattaaaatattaagtagaacaatgtcacccaagagaactctctgcaatgatgaaaatgttctccatttgcactatctcatattaatatatacacacacagacacacacacacacgtacatagcatatgtagccattagctacaactacctatggagaacttgaaacttagtgaggaattactctctgagttttattaatttaaagtagtttcaatttaaatagctgtctgtgggtagcagctaccaaactagaaagcacagaagaagagaataaaaaccactggtgtggctggtcccctcttcaactgacaacgcggagactcactgggcagtgaaacagcttgttttaatctgtgctcatataaaaataatgttggcccgagagaaggagaaggaagaaggttttactcgtggcactggggtaggacagaaacaggggggacttccgtagtgctagaagcagagaaaaggttctcgccatcatgtgcccttatttcctacaccaaggggatctgttcttgagacgcacctggacagcaatggctccatctccatttccatcaccacctttgaaatctgacccatatgctcaaggtacagttagactggcacttcttgtatgatttctgcccttgatttccattatcatatgatatttccctaaaaatgacatctaagagaaggaaagtagccagtgcagtctcatcctcttcgaacagctggcttgcaccaacaccacagaaccagctactgataaggagctgctggcatgaggcgtcccccaagcctttgtccaaagccccccacattgccaagcctggctattggtggtttcagctccttccctctttcctccttctgactacagagttgtccttgtttcttacacatcaagaatgctgctgctggtgtcattagctctcatttttcagttacacctgccatattccctcagttcagccctgcgcctagtcatgcagggagtcacctcagttctggtggagccctggattctcctgtggaatagatgcatggccagagtttctggacccgggacagggatctggtcagaagtaacagcaggggcacagaaccttcttcctcatcatccatcaggattattgctactgtatttctgggtgctggccttcagcagggcttgaccacatttgctggaatacacgtctccacaaggacacaaccagtatgtaccaaatgaacagaatcagcaccacctctgatgtccagcaagcgcttctttacacattatggagagagaacccacttttcttcatgttgagtgaaggtattcattagttctagtttaaccaatatgtacagaaatagtccaaagtggttccacatgaaattcatttggactggacttcctgaatcacctcttctaaggacaccttgctttggagccttaaaaagatggggatcggcctgccgcagtgactcaagcctgtaatcccagcactttgggaggccgaggcaggcggatcacaaggtcaggagatccagaccatcctggctaacacgatgaaaccccttctctattaaaaatacaaaaaattagccggcttggtggccggacccctgtagtcccagctgctcgggaggctgaggcaggagaatcgcttgaacccaggagacggacgctgaagtgagctgagatcccatcactgcactccagcctgggtgacagagcgagactctgtccccccaaccaaaaaagaaaaagatggggataacgaccatttcaccattatgcaggttactgggggaaaagttgctaaactgggcaggtcaaacacggaggcttcattatctcactagaaatctccctctagggagccacagtcagcactctctggaaaggtcatgcagccaaccgattcacttgaccgtcctaacatcccactcagcgcatggccccgtgtctgcccatctttccgtctcactatgtgagtggaccactctcttcagttgaacgcttccttccctctccttctgaaggctcatgggacctcatgtgcacaccactggccctcaatgcgctcaccttgacctttctgtacctgtccaaacttttctatggatacaacctctctgtgtgtaacacttcactctatttcatatgctccaaatggctagtgaagttccctgaactcaataaacactcaataggtatttgctaggtcaataaattctcccatatttttaatggggtgaaaactgaagtgagcatggtggtgtcagggcaacaaatataaaatagaatgcagccatgatcattcaatatctagaacatctttcctaccaaccagacaccctttaaattgttgggatatcatatttgaaatcagtaaaattaaacattagaaaaattacttacataagaactaaaataaaaaaatgtttatataggacttggtgtaactgaatgttaaggagaaaaagtgaaattctaagtttaccaacaagtagaactattctaaaggaagacagttattacatgaacactcttcactccaaaccttgtccaataggttattacacccaactgaatcaaactgcctgttccatgcttttaacgagccataaacttaactcctgtggagtaaccaaggttatgctatattgtaaacagcttccaattacataaccatccatccagtgaatgtacttctaaaaaatacttctaaaacatgcttagcaatctctaaggagactctacacttaaaagttataacttaattctcaaatttttgctggggttttaaattaacgtatctgcacaataatttgacctactgaggcaaaaactgctgattaaatctaatacctttttctgattttttggttgttgttgccaatttattttttcatttttcattttgaaaataataatgaaatttcccataccaagacaaaactgtagagtgaagcaaaatttaagaattaggtttaaataaataacaaagtacaaagccaaaaagagtaaatgtagttgctttttctttcagaaatggatacgggccaggaaatgggcacagttaaggtggtgccaggaaagtcacagctttccaaaagttgaataaactccataatataaatgtagatggaagaaaccatcaatgctgcagataatgtgtccagtttcctcacaatgacatctctatagcctggggtatgtccatcttggcttaaagaggcagcacctatgggaaaactggctagccatatgtagaaagctgaaactggatcccttccttacaccttatacaaaaattaaatcaagatggattaaagactaaaatgtcagacctaaaaccataaaaaccctagaagaaaacctaggcaatgccattcaggacacaggcatgggcaaggacttcatgactgaaacaccaaaagcaatggcaacaaaagccaaaattgacaaatgggatctcattatactaaagagcttctgcacagcagaaactatcatcagagtgaacagacaacctacagaatgggagaaaatttttgcaatctacctatctgacagaaggctaatattcagaatctacaaagaactcaaacaaatttacatgaaaaaaacaagcaaccccatcaaaaagtgggcaaaggatatgaacagacacttctatgcatccatagaacagacagctatgcagccaacagacacatgaaaaaatgctcatcgtcactggtcatcagagaaatgtaaatcaaaaccacaatgagataccatctcatgccagatagaatggcaatcactaaaaagtcagaaaacaacagatgctggagacgatgtggagaaacaggaacgcttttacattgctggtgggagtgtaaattagttcaaccattgtggaagacagtgcagcgattcctcaaggatctagaactagaaataccatttgacccagccatgccattactgggtatatacacccaaaggattataaatcatgctgctaataaagacacacgcacatgtttgcttattgcagtactattcacactagcaaagacttggaaccaacccaaatatccatcaatgatagactggattaagaaaatgtggcacatatacaccgtggaatactatgcagccataaaaaagaatgagttcatgtcctttgtggggatgtggatgaagctggaaaccatcattctcagcaaactatcacaaggacagaaaaccaaacactgcatgttctcactcataggtgggaattgaacaatgagaacacttggatgcagggcggggaacatcacacactggggcctgttgtgggatggggagaggggggagggatagcattaggagaaatacctaatgtaaatgatgagttgatgggtgcagcaaaccaacatggcatatgtatatgtatcaaactggtatgttgtgcacatgcaccctataacttaaagtataataataaaaaataaaataaaataaaataaaataaagaggcagcacctctctggagccatgacctctttgtcaaaccctggcctggccttgtcacctttgggaaatcagctggccctcaatgcctgttctctcatctgcaattatatgtctactattattgtctcagtagacaataatagtatctaactcagtagactgtggtaaggattttaaaaataataatggaggtgaggcacttagaacaatgtctgctatacatggaatgttcagcacatgttgtttatttgtatttgctgccaaaaaaattctgaactcaagctcctcccacggattcttcaagctgtaggcatttacccctcctacttcctcaggtggctactttcctgtttaataaatgttgattcttagacagtatttccatcttaaatccactgcatttttgtaaatagaggaaatataaatcttaaataattctttttaaaattacttcattcccaaccaaatcctttacaattaaatatttaataatattatggaacacaaaccctgatggaaagtcccaaaattgattgaaatttttctagaatcatatttgtttctgtgaatcacttttttattatgaggtaagagatacaggggtggactgcagaaaagttaggaaggaaaataataaacaattacatgatctagtccagttgataaaattttcaagttggctaatatgctttaaaaaaaagtatttccaaaataaaagctttttttattgtatggttgtggaatggtactaaaggggattcaatatgtatttcaaaatttaatatgaatggcagacttgttaaatttgcatccactcttctttgaaaggtaggtacgattgtcagcatttcataacaaagaaaacacaagctaatgggttgaatggtgtccccaagacagcactcggggtcatcagagatttacaggtaagccttcctcattagaaagcacaagctttccttttaaccacatgataataaccttgagtcagacggtggactttacaaaatactgtaggggactgattccatggctcttgcaaagtggcacttacacacagatcggcaattatggacccaggccagcagtcacaaacaccactgcaggtgctggctcactacccccacatccctcatgcaatcagtgctaacagtttcatggaaattcccattaatgttttaaagcactggcattcagtaagaatgtgcaggtacagcaattaccaatgaggaaaattaagtctcattttcaaagattagcacatgttctacaaattgaatgttatcccaagaaatggaatccatggaatgacctgagaatcaatacaatttcttttttatttttacagaagtagtacttttcttgctatttaaaaaataatttaaaattttttaaaaaaacattctaagtgttagaaaaacctgttacgtaaatgaaccctcagaggaatggcattaattaagagagtagagcaacacggtgtgagcctccaaactcccacattctttgttcatcttcaatagccaatataattagttttgtataaatattttatttacatataatatttcctatcttcactgctaacataaaataaacctcttacaaatttcgatgctttaagcatcttatttcacctgtaacaaataagacaaaacattcaatgttaaaaaatttggatcatttctagtattgatttccaaaagcttttggtggtgattgagattcataaaatctctactacctcttaaaagaggagaagacatatttttctctagtaacatactgataagttagaaacacatggtgatgtcatcatgctggggggaaaacatagattatttttttcctttaatcaagactgataagactatgaattacatattgttctaaaagtctgcactggaataactccagctgaaacactcttcactggtactgtgggaccatgaaagtctttctatatcatgagtatctcagtcaaaaggtttccaggaatccatctaagacctcactcaggggccgcctctctcctaccctaaacactccttgctgtaagttcccttcaagttgaatgtctgtagcaggctgagctatcccatcttctgcagtgacttcacctgtttaagtcagcaatcccccgagatttgaagcttctcaagggcaagtttcatgtcagtggtctcacttctattccccacccccaccttcaaccaaaaagaatgttgtcccaggaagacattaaaccctgtgaatgatcaagtaattaagaaattggtgagattaagaaagctcgcttaaactcaacattttaaaaacacaggaaagttgctcggcctgtgctacagattacagtaatgtttctgtttacttttgatattgtctctgcctaaagaagaaaaacatcgggctttgagaatgctgcagagtcacaggccggcatgtattcttcattgcctctataaaaggtaaacttagagaaatctaaacatgcttatatacagtcaggcattgtttaacaacagggatatattctgagaaatgtgtccttagacgattgtggaattgtgcaaacatcagagtgtacttacacacacctagatggcatcacctagtacacagctgggccctatggtacagcctattgctcctaggctatgaacctgtagagcatgttactgtactgaatactgcaggcagtaactgtaacagtaactgtaacacaatggtaagtatttgtatacctaaacatatctaaacatagaaaaggtaatgtgacattatgagggctatgatatgactgggtgatagaaactttttagctcaattaaaatcttatggggccattgttatatatgtggtccatccttgactgtatgtctttatgtggtgcatgactatattagcagtcaataggaaaaaaaatgaagatataaattgataatttatcagtcagtatctagctttctaaatgtactttaatcttgtctgcaaaaaggattgggttgtttgggaaaagggagaatgatggttagaaagtggggtggtggtcctaaagaaacagaagaatattaaaaacctatcaagatgccatctatcaataatgttaacaataaatattgggggaaatctcatggactcaacactagtagtttgtgagaaaataatgaaacaatcaagacaagcctccctttaacagttttcaaatcctagaataacactgagatgtattccgaaacaccgtgaagggtatttcacaatgcatacacaactgggaaggagcctagcatgctcacaatagtaaaacgatgctgggcacagtggctcatgcctgtcatcccagcagtttgggaggctgagacaagttgagcttgagctcaggagttcgagatcagcctgggcagcacagtgagacttcatctctacaaaaaataaacaaaaaaatagctgaatatggtggcacatgcctgtacctccagctaggaatagctaggaggctgaggtgggagaattgcttgagcctgggaggtcaaggctgcagtgagctaacatggtgtcactgcacttcagcctgggctacagaatgacaccctgccttaaaaaaataaaaaaaatgtatattttgtagaattattactatagtaaaaatatttccaaaaaaaaaccatacacacacacacacacacacacacacacacacacacacacacacacacacacacatatgaatagtaagaagtaatagagtcttatattgaaagttctttgatgtcctattctggaattattctagcttcactttcccatgatcctgtgttctatccagatgcatccactcatacccttaggaggccagaaggcagccatgcaccctagatcaaaaggtgttggctcaatgctgttagggagtgaccccagacacatcccctatctctctggagcttggttcaggtctcagacgtacagcatacacacacgaacaccaaggtgccaggagacactgcaggaagaccttcaaaggggaacagatcaaacaaataggcacctgaaggaagggaagggaagtttagaggtggggccaattcaacacccagagttctatgacttccaattgcacgcactttgtttcagctgtaccatcttttctatctccagtatcctaggttttgagcagcagaatcgtggtttccctagagagtcaagacagaaaccacagcacagactgcctcctctcctttcttcagggttggatggttctctctgtgtagttggggatggcagccactggttacctgtggctctgagcacatgaaaggtggttcctgaaactaaggaattcatttttaaatcttatttacatttgtttaatttaaatttaaacagccagttctgtccagtggttatccaaatttgggcaacacaggtctaagggaatgaattccttcttaacacagattgaaggttccagggaagttacctgtatatttgcagacttttatccagtacatatgcaaataatttctgtccagtgaaacagataacacccaaaatgtgtggcctggcggaaatttcttagttgataaatagatagatagaaagatagatccctaatttctcaaggctctctgaattggtcatggtatcttatgatgtccctcattcattaaaagattaaataaaaatttttacatgtgttcactttatatttgctttataattttaccttttgtaaattatactttaggatcttatttttgaggagagagaagattgttaaggctccagcttggagttgtctctcaataagtaagcaataaatattcacctttcttcctcatcctttatccctgctaacagcatctaggaatccttatttcatcctacttccccatctgcaaccttattgggcccagaaataccacttcctctaggaagtcttacttaattcctccatttaatgtaaatcccctccccctaaatgcccactacatttgagttgcatcattcttaggggtcgtaagctacattctatctcacaatatcccatagataattttatctctcctaccaggctttagattcttttgaaggtgaaggctacattttattgcattctccctggtgttgatgaataaaaacggtaaatattatgtggaggaaccaaataactagacttgaaactaatggtgtggtataaaaaagtctttcagcttgcaaaagataaaatcacaatcaactggccttaaaataacttaatctctgtgacaatataatgaggaatgttcttccaggcccattaaaatgacatgcaatttgataattatttttacagtgtcaggattctaaactaaatgtttctcagcttctgttatctggtgatactaaatgaatgttgtcaaaagattaaatgtaaattggttataaatcttcatttaaccacatcatgcagggaaggttacattacagccaccatgttcgtgtcatcattaagaaatggagtcttattttaatagtattaagactattgaaattattgtttattctatctaattggctttggagttgaggatgaagcttttgatgggcatcactgaatacaggagcaaaactgaaataaaaatgaggggcaggccgggcggtggctcacacctgtgataccagcactttgggagggcaaggtgggtggatcatgaggtcaggagttcaagactagcttggccaacatggtgaaaccccatctctactaaaaatacaaaaattagctggcatggtggtgcatgcctgtaatcccagctacttgggagactgaggcaggagaattgcttgaaccgggacccgggaggcagaggtagcagtgagcaagatcgcaccactgcactccagcctgcgctacacagtgagactctgtcacaagaaaactgaagggcaatgaacttaaacccttctggaccccaaatggacaaatggacaggatggggaatagctgcagccactatctgcaggaaacactatcattgtctgaaaggccatcttcactttctaactagattttccaaactaattaaacaatctaatttcagtgaaaagtccttcttttaaaaacccagtttgcggccgggcgcggtggctcacgcctgtaatcccagcactttgggaggccgaggcgggtggatcatgaggtcaggagatcgagatcatcctggctaacaaggtgaaaccccgtctctactaaaaatacaaaaaattagccgggcgcggtggcgggcgcctgtagtcccagctactccggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaacccagtttgcctggctttttcaggaaatgacctatggtttgatcacctgtccaaaccatctggcggcaggaatgtgatctagttagactctcacagacggtgtctgggaagctccatcattgggctttaatgttaaagccacacggccacacagccaggacactttgatgaacagccactcacggacacagtgagcccatcatgagatgatgagaccaagttgcattacaatgattttgacagccagcaaaattatatttaaaaatgaaatctttcttttggttctgtatttgaagtaaggaaaatcactttgggggtaaaatcagggttttggaagaaactgatacttcttattaggtttaatttaactggcagtaataattaggacatgataattataccaggtgaagcctgcaatagacttagttctactttaatacttaattgatattgcaaacaccaagattttcggtgtacagacaaatatagtatccttgtataaatgtatatgctcaactaatgcagctattctacaatcgaagaatctctccttaatcaaggaaaatgattcatatcagaaaaactgtaaaaagcacctcttgacacattctccatgtgctacatgaaccaaggcccaatcatttgttcccctcagtctctctcctgatatgcatggtttccacatccctttctacagcctctgtgtgggggtaggaagaaggaagcagaaaaacaaacacacacatccacatgttccttctccttactgctctggcttctcagacttggtcccactacttacatttttttgtttgtttatttgtctgtttgtttgagacacagtctccctctgttgcccagcctggagtgcaatggtgctacctcagctcactgcaacccccacctcccggattcaagctattctcctgactctgcctccctcccaagtagctgggattacaggcgtgtgccaccacacccagctaattttttgtgtgtgtatttttagtagagatggggtttcaccatgttggtcaggctggtttcgaactcctgacctcaagtgatctgcccacctcgccctcccaaagttctaggattacaggcatgagccaccatgcccagttttaaatttttaaaagagtattaataaatacatcaatcagaggaatatgtaagattctactgagaagcacaattcctattagcgcaagggagacaaaaacactatcatggtattgttaaggctccagcttggggttgtctctcaataagtaagcaatattcacctttcttccctatcctttatccctgctaacagcatctaggaatccttaatctatccgacttctaagtaggaggtgagcaggggtgtgggaaaacattctggcaggatctctatgcaaaagaaacaggtggtttagggtgcgattgagaggtagacatgtcccacacagctccagcacagaactgcacgccggggtgacaggtctgcctttcagaggactaagctgctgtggcaacagccagccacagccctccagaggaaggaccacagttcataaactttagagtctctgggagcacttgctggggagcagcgtgatggaggtgctttccagaaggcggtgctgaccaggccgctccctgcggaagcccctctggggaaggacactgggcagcaggaatgatggtggtggctcagcaggggtggagaactcctgtgtgcagcctgtgttcctgctgagagaggccccaagccctggagtcatgacatcaggaggctgtcgtgactcgttcactaggtgtgggaagcccagcactgtgtagtacatgctgcagagggcagaaccctgaggtgtgtggcagcctagagtcctgctgagcatggcagccggggctggaaacagtgaggcctgttctggagtgcctctgtgcaaatccacctatctggggttggggattggacatgagttatttattcgtttattagttattaatttttaagtttaccagggaaattgcatgcatagcaaaatatggaaaccattcattaaaagattcatgagactaaggtatcagttcagtggacacaaaataagcattccaggagtagaaagcaccctactttgtggggtgacattgagacagtgctgggaacctaacagtgaagctccctatgtgaggacctggtgccacaaatggggtggtagataatgcacatgggcctccactcatgttcctccgtggcagcgaattaaagaacatccatcttcttacttcttttctgtttctcagttgccaaccatatgcctgtttagttacacacctcggcatggtggctcacacctgtgatcccagcactttgagaggccaagaaaggtggatcacttgagcccaggagtttgagaccagcccgggcaacatggagaaaccctgtctctacctacataaaaaataaaaattaataaataaattagctggtcatggtggcatgcacctgtactcccagctacttggcaggctgaggtgggagaaatcacttgaacccagtaggtcaaggctacggtgagccatgatcctgccactgtactccagcctgggtaacagagagagttcttgcccaaataaataactaaataaataaaataagaaatcagccaaagacttcacttgctctgacagaaactttcacaaaatctactagaacgcagtggattcagagatctgtcaaacacttctttatctaatactgcataggtgactccctgtctagaaaaattaataaaaactgacaagccacctgcactgtagctcttccgcttcctctactgttcattattggctttatttcatttctatattaaactgcatattacaaactcaggccagctggatctttgcatagatactatatcttgtttctgccagagatgatttttattcagaatgaacagtaaaaggcaacactacgtagaaaatgcacttgagttttaaaataaagatgaaaaaacttgtgcatcatccaatggtcctccgcagcatggaggaaaaaaaaaaaaacatacttcagggagataatatctttccttctccatttcacaaatgggtatcttcaattaaaacacttgtttagattcattagtgtttccttgatttgattcttcggtccatgagtaaatacattttagagattaaatgattagtttctttacatatgaaatagggctaatagtatttgcctttaatgatgttggagaatagtaaataaaataaaatacccttgccaggcatgtacagttgctcccttgtatacataaaggattggctccaagacctcctatggacagcaaaatccaacagtgctcaacacctttatataacatggtgtggtatttgcctataatctgtgtatatcctctcatatattaaaattgtttcatcagcaatggggaaaagactccctattcaataaatggtgctgggataacaggctatagatatacagaagaatgaaattcaagatggattaaagacaatccatcttggagttcatttttctgtatggtgattcctatacagaaaaatacctatcaccatacagaaaaatcaactcaagatggattaaagacttaatgtaagacttcaaactataaaaatcctagaagaaaacctagaaaatatccttcccattctaggccttggtaaagaatgtatgcttaagtcttcaaaaggaattgcaacaaaagcaaaaattgacaagagggacctaattaaacctgcataattaaagagcttcggcatagcaaaagaaacaaacaagggagtaaacaggcaactacagtctggaatcttcaggaatgagcccagcaaggccagagttcatgggggaaaaattttcaacataaacgtaaaagagtgactaaatcaatcaagggtaagaagtgaagattcaagtacaaagcagagggcagcaaaccaggtacaaaggaatctgtcacctatgcagtgagcataacccaacaggtagtttctcaaatcagagacccaaccagtaaccaaggtaaaagagggactaaatcaatcaacgaaaaaaaagtcaagatgcaagttcaaggcagaggtcaggaaacggaactccacatggacacagaatggtctactcatggcgcagccaaggggaggggcaggcagccgtcagggaaaagtactcaaaaaggcaacacttaccgaatgactgaaatttggagtcatggatttcagcagggatttgcagtgaaagaaacaggcatatagagactaagttcccaataaacgttacaattcatcctttcactctcctcttgaaatgggatgtattgtgaatgtattgagctaaattatcctgcatggctttggccagctatcccattctctggtgagtgtttattttcaaagagttagatgagtgaagagcggagaatggtaatgtaaccaatctgatgccttgttagaaaatcttccctcatgataccagaatgctttggtgtgaaagactggttcctgctggaatagtttcttttttaagactaatgcacaaaaatgcatattctgcctatgtttcttcccatgatgtgtattcatttagtgcgtaaggaattatttcttttcttccttgttcgcctcagtcctagtgcccagctcagtatcttgcatttgctgctagttgatgacactgaatttgcagcaaaatgaaatagaccttcttcaattggtctggtctgtttgtcactgagtatatgtgtcattgctgtgacagtaacctggctgatgaatgaaatttactggactatgaacagtaataagatattcctgaagccctggtttctcactttgctatcttaaaccaaagctattaaactcttcaaataagcatgctttattcagtaattcatagacttcaattaaatttggagcagcagagaactctgaacattcccattgatgccacagtggtatggccagagctaggctcaactgctccaaaatcgtcagccaaatacctcagtctcccaagccaaaatttgacatagactatgcttctccggccttatttcattactcaaaataagatgattgaaaaatgtatgaagcttacagtagaatactagtgggcacaagagaggagatgtaaatattcaggtaaaactcaataagttcagaaaaagattttcagcagatgcaaattaattggaaaaaatgtcagatgataaatctttgctttaccactttgcagtctgggtttgacaaggacataatctctaaaaaggaaggattttcaaaagaatcaacagaacattaaaggtatagagaattcagacactaattcaatcatacataatcttatctaacagttaatacactttctaagatgacgtaccagttggaggataagatgcaaaggatgaaaaagataaaagtagatttaatgcaatgttttacaggtaaaacattggttttggtttgaataacgaccttttactcttaccactttggacaacataggaggcagaattctatgataatccccaaaattccagccccctaatatacatgtcctatgtaagtaaccctctcgccttgagtgcaggtggcacctgtaaaaatgatcagatatcctcctattaggaggttatattaaataccaaagataaaggatttttgtagatgtgcaaaaggtcagaaatcggttgattttgaattaatccaaaaggagataccctgggtcggcctgacccaatcagagaagctcccatagaaaaacagtccagatcttgtggaaacgaagatacggagatagagcttccgaccgctttgaagatgtgaactatcatgctgagagtcccacgtgtcagggcattgcaggagcctcaaggagctgaaagcaaccatggctgacagccagcaagaaagctaggacttcagtcctacaacttcagggaatgaattctgccaacaatcatgtcagtgtgaaaaatgaatcccaaactgcagaaaggaacatggcccaattaatgcgttgatccatccttgtgagaccctgagtggaggatgcagttaagcactgctcacaatgtctgcgggtcagacctgaggaaatgcgggacctgactcacagaaattgtgagatcataaatgggtgtcgtttaaagccactgcactagtagtaatttattacacagcaaaaaatgactaatacgtgtggctggtttacttcacctcactgttagttttcttttttttaattttattttattattattatactttaagttttagggtacatgtgcacaatgtgcaggttagttacatatgtcatatgtatacatgtgccatgctggtgtgctgcacccattaactcatcatttagcattaggtatttctcctaatgctatccctcccccctccccccaccgcacaatagtccccagagtgtgatgttccccttcctgcgtccatgtgatctcattgttcaattcccacctatgagtgagaacatgcggtgtttggttttttgtccttgcgatagtttactgagaatgatgatttccaatttcatacatgtccctacaaaggacatgaactcatcattttttatggctgcacagtattccatggtgtatatgtgccacattttcttaatccagtctatcattgttggacatttgggttggttccaagtctttgatattgtgaatagaagaccataataggagggcactttaagaatttcatgtgattgacactcttggcatgtagctagcatgtaataaaagctcagtagaggcagttaatcataataatagtgctgctaatagcactattagtagcagcagtataaactgcagtaattgtgacaggctggaactcctagatatgcttgtaaacaaaattaaattgggatgaagaattctacaggctggtatttgactaaattaaatcaatgcttgattaaatctattgacatctatacgtatgtgtatattggcttattccaaatagacacgtgacacacacacacacacacacacacacacacacacacacacacacacacaaacataatgctccagaaacagcacagtatacctttctacaaatacactacacattttcctacctttgtatctctttcttatgtcctggtttttccccctgaaatgtcattcccacagctctacctgtaaaatttgttgacttttcattgcctacctaggatattgtgtattaacaatgttccaagagctgttgttgtcgttttgtaatatgagataggaatcatatgagataaatattactattattccaatgtatccctttttaaaggacagggaatgaaggactacaaagactgatttggctgtgttcgtggtgtggtgtcagcatctgaaattagtcactcaagctcctggttgtgccttccaccaccacaataagctttgagtcgatggcccctcatagatactcctccataccccaaaaagatttttttttccttttcttatctcttaacgatattttatttgacttagtagggtttaagctaagaccaagctgagctatatttggcatatagatacactgagtttacagaactgcctaacaatgttctggtcaacaatggactgcatatacagtggtagttttataacattacaatacggtatttttactgtactttttctatgtttagatacacaaaaacttgccaatgtcttataatttcctgtagtattcagtccattcacgtgctgtacaggtttgcagcctaagagcaacagctgtaccatgtagcctaggtgtgtgcgaggctataccatgcaggtctgtgtaagtccactccatgatgttcacacaatgccaagatcacctaacggtggactactcagaatgcatccccctcaaaaagtgacccaagactgaatttacatccactaatgtgcatgtggggaaggacaagttggagaaaaagcttgatgcgtgccgtcatttatactttcccagttggaggagagaagccaatcaaagggaattaacagagaggctgcaggccttctggaaggaatctatcttgagggaagtaggcctggggaattggatgctgctgcatcctctttctgggcacggacccaccctgacccagccactctagtattatacgccctagggagaaaatcatggcaaaaaattaaggttgttgctgcaatccccagggcccaagccatcttgctctgagctgctataagagttttacacagtgcaaagccattttctgatcaaattttataaaaaaccatactcatctgagatgccctgggttagtggtacccgaaactcctggtgttcttgggagagacaggcctgttgtcttggttcattttctgtggttataacagtatacctgagactgggtaatttatcaagaaaacatttatgtagctcacagttcttgaggctgggaagtccaagattgggcagccctgtctgggctgcatcataacatggtagacagcaacacgtggtgagagcacatctatgagtgagcaggtgcaaaagacaaaacacaaagagtgaccgaactttataacaacctgctctcatagtaactaatacagtccctcaaaagtaagaacccactcttgtcagatggcattaatccatccatgactgtaaataccttatgacccaagcacctcccgaagttcccaccacctttaaaccaacacacctacattggtgaccaagactcaacaggagcttctgtgagaagaaaccatattcaaaccatagcacctgttgaacttgagaaattcaggcttacatgttattgtggtctatttttaaagctgagagatcgggataccttctttcatctctttggtatcttcagaagtttgaaaagtatttctaagttaatctaaccttctttttcatactaacctgacactgatgtggccaaagagacctggagaacctgagatctctgctgtgcacatctccccaacactatgcaccttggagctcctcatctctgcaccctccatggagccaactccaatgctgtacacacagcagaggcttaataaatgtgctttgaccaaagattttgttgtatcaacccacagtaacaaaattgacagtagatgtagctgatgtgtttaacttcagaaaacatatatggggaaatctcatataaaaggacaatgtggatttacctgggaaatagttattaactaatgtaaactgctggctacagaaaatgactgctgttaatgtagggctgtatatatatatatatatatacttttgttatatatttatacttctattattttattattttatttcctaaacatatatgtttaggaaaccatatgtatatacaaatggaaagagttggaagcaatgatcccccaggggaatctattgcatacaggtagggagaaggcatcaataagtttaataataataataataataataataataataataaaattagatcaaactgggcaggttagaaagaacttaaggagaaagagtcagtgcttaccctaagaaagaaaagactcataaaaaaagagagactgagaaaagcagaaaaataagaatcagggctatgcgctttgagacagacaggcagacaagacagaggcagagacagatacagagagagagagagagacacgcaggcaccagaaaggagagagtgctcccctccaaggctgcgctgcaccccttcctgggtgctgtggataggggccctagggctcctccttccacaatggcactgtaatgggaaaggcccacaacaagcatgaaaccagtcctcacgagcagagccatgtgggtcaaattactgcaatttgggagaaattctgcaaagacatttgggagggatttgtgcaggaggaacaccaagaattttgtttgtttgtttgtttgtttgtagagagagccttgctctgttgccaggctggagtgcagtgctgcaatcttggcttactgcaatctccgcctcctgggttcaagcgattctcctgtcccagcctcccgagtagctgggactacaggcgcctgctaccacgcccagctattttttgtatttttagtagagacggggtttcaccgtgttggtcaggctgatctcaatcttttgaagtcgtgaactgcccgaagactccatgagtataacaagattaacttgagcctaagaattcctaggcatgggcagctcgctgcttcagccactggctcaggccaaatcagttcttcaaaatcagtcatggctccagtcccctccttggtatatgctgctacttatgaggaaatcctaatcctgagcacagaagttcattctcttgctgcgctaatgatccggccagaaagtgctgacagccggctggctgcctggctggctctcctgcaaatgcacagtcttcttgtcatacagcaggaggagcacaatggataaccagtgtatatatctacatttaactttacgtaactatcctagtatacgtatgggacttgcatacagtcttccgcatatgtacatctttacgtagttggtatgatttctctgtaataaagtccaaattttagtgtgtgtgttaattctcttaacatccacaccctttactcattgactattgcattcatttttagctatgcaacactttgaaaataagggtttttttcccccaccttaatgtaataaaccaaaccactgcaaattttatcttgcttttcattatctggaataatttagctactttttttttctctctctaccctttatatctatatccattagaacacagttcctgaaaatcatggtttttgaaaacccaaaacatatccaattatagtttaaatgtaagagactctctcaatgatcaataaatctgacacccacaaacacttgttttactttagaaatggcgcaaatatgtgagtcccaaattatgaaattatggtgttgattttcactttgtgcttgacctctacctgaaggtacaaagctgaggtctaatttgacattaattaatcttactctcttcccctcactcttaaacttgaaaaacatagtagggaaaaatgcactagccttctaccattcttatgccctatgtgacataaaaacaaaagtgaagttagctacttagtcaaagctggcaaatgcattctcaccatccctagtgtccatacagaaaacgtgcatgccttctggacagaaaacactaaggttgtgttcctctattgaaatttgggggaagtccaaaaagatggacaaaggatgttgtattttaaaaaccagtagttccattaaaaaaaaaaaaaaaacttaactacttagtgacctgagtgacatcaatgtgttcttgtgagggctattttctcatgtttggtggtgaatgtgcagacacaatgtttatcgtagagagaattctccaaatagaaggtgtagaaacctcactacgctgagctcattcaaggacctgggcataaagcaaattacaagagggattgaaccacgtaataagagagaagcctttagtctttatttctactgaagcaggtatgctttagagagacgtgtttcaactgaaatgcacaaaccacaaaatcactaaattcaaaattcaaaagagaaattcatcataagggctgtggaattgacttcttagagtatattttgtggaaaatagaaatctggagcactacattttagatgcaaagcataagtgggtccccgatgttacagttggtcaaccacacgtacagacagggactagagactcttctctccaccttcaaaaatgacaaatattggtaatgagagtcccagaactaatcctttcctgtataaatgtgaatgctcatttaaaatttgaaaaataaagttatgattcattaaaatgaaaaacaagaaatttaggggaaaaagttcttagtccattgatcactcatctcactttgctgaaagatcgttaaatggtttgaaattaatgtctgataaatatgtgagctgattgaagttataaatatcttcaaacagctattcaaagcttattaaaaatcttcactttaatgaggcgaaaacatgaaaattgactctacctaatgcctagcagagtccaatattgcactttacatattggtttacaaacattatttccaggtgtctttaaatagagctccaatcttgcactgttctgatttttcaaaatccttccagatatttggactcaagtaccatcactaagaatagaacccacagtaacatcagcctagccacaagcttccacatgcaccaccagtagctgctgctttgcggtgttgtatgctggatcttttgtacacctctaaatgatggaaggtaccacagcgcaatctatgggaccacttctgttttctatccaaactcgctgctcaagtgatcttctcagtcctatggcttacgtatctaccctttgctttttgctaaatttatgtttccagctttgagctgcagatttgtacagcaaattgtctccctgactcatctgccttgccatctctaaattactatgcccaaattagaatccctgattgttcttcaacaaaacctgcttctgcctagtctcccccatcccaacaaaaacacccccagtcacccaggtgttcaagtaactgtgattcatccttaatttctctatttccatcatattcagcttctaatccatcaacagatactgtaggttttatcatcaagatcactccagaatgagaccacctctcaccaccttcagaatgacacaagcgtcacccacgcaagcacctgctcttacctggaatccattacctgcatccatttcagcctgcctgagccatttctccaacagaggctgggcttttcttttagaaacatgaattagagcccattattcctttgctcagcacctgctgatggctacctatgcatattctttacacacatctgcccctgcccctctcccagatcaccagttcattcccagatccagccactctacatctacatacaccaaactcaatatctgccctcggccttggcacttgccattccctcttcctttccactgttcctctcaacattgcacagctagttccctcaatctatccagcactcgacttagagaagcctttcagaaatagtctgtttttgtacaaacgaccaatacctgtatcctttcgatctgtttgacatttctgtatggactcataactagctcaaattatatagcaaattaatttaattacttgcttactggccatctttcccactataaggtcagctccatgaggctaggaatcctgcctgttgttttcaccattacatctgagtacttagaaccactccgccacagagcctgcactccgtaaactttcctttattgaaggaaacataattgaatgtgcatcccttttcacagcctgggtaccagacaattcttatattctattattgtaaaggtaaactgaagtgcaaataaacataactttgaatagcaaggttgtaggttgaaatcaagtagtcattacatatgtatatatgcatgagcatatcttactgaagcaatttttatattattggcctatatggagccagtgaatactcaaattaactgtaagtgtgtctatctgttggcatgagccaagaagtatgacaacagtgacggttcacagagcaggatgtagctggctgcatttgctgtataccaagccagctccttggctagaagcaagtgggaagaagcacaccctctttgaaataatcctgcaagaggcaagctgggcttgaagtctgggaggatccaggggaagagtgaagaggaaggcactcagctgataaccaacttcctcacttgctccacttatatttagtgattgctctgatcacaatttgaataatgctcaccagagactgttagtcagaacaatgtgtcccctaggactgatctactgacttcaatttcatgttctaatacagaacagcatacataacttgaagataggaatctacacaactgtgaacaatagaggagggtcacagaaatctaataacagcctggagagaatcccattcttgctttgctgtcatgccaatgaattgcattctacaagaaactctgttaattgactgctcctatcttgcaccaggcaaaccaagtcacagtgaagagaaggtatccatggctctttaaagcagtactttataaaaattctatgcatgcccatctgaaaataacttaaaatctctgttgtagctttctgatcttctttctatctcataaaaaatatttcaaagtaacatcgtgggttcagacacctgtctccccaatgtgatgtaaattcattggactgatggttcctgtacgacaaatgctggaggtgctgaaggcattccatagatagcttatcagctttctcagaaattaagaggaaattcgctcctcactggaaacctcagataaatatgcctccctctctctctccttttcctttctccctctccttctctctctcctctaaactcagttagtttccaaagaaaatatttcagagagctgagagatcctccctaatacagaagccaaccctcctgatcaccctccatgtaaactgaaatactaacatttctcaatgtttataaagaaaatttactttctgaaagggaaaaccaaatttattgtcccagtgttataaatagtgtttgtaattacaaattgatttcagagaatgtgaagttcagttatgcctaaatagataagcatactttttaaatgggtaagaagtcattgggaaaaaatttaacagtggtgttccctaactccccaaaatctcttcagatgaggaactgcattttatttatactgagaactgcaacaaagtgataaggtgtgagagggaatcctggaaagacagagcagacagtatcagctgcctgctggatctgtatctaggacagtgaaatatcacaatttgatcatttgggaaaataacagccatacacatagcacggtcctaggaaaatcatacttgtgtggtaatcccattcaataggttaataccgaatatgctgaggttttggtattgtgaaattagagagttacctattcattcccaaatcaggaagcctaatttaaccacctgatccgctgtcccaaatgattaactacatcccagagagagaaaaatatatatgaattaaacaaggcaatctctcccagagaagacagaaggaaaactaaggaaatgcagtgctctgtaatttctctggccccacctcactaataagggcctggctgggttaaggctgctgtgtccacagtatcatagtgtcatcacctgtcacctagagatgggggtctgtcactgtgaccacttccataccccttaacctctcagggaggttaatttcacagcccttggaaagccaatttctaacatagtgtcagaataaggtatcactttcccagaacagggagagaggctttatctcaagattatgcgaaacgaggggtatgtagggtatgagcagccacatagggatttggctagcctgacaatttctgcatctcctgactcctattttctgagcctagctcacggcactgttgctgacctgcagtgcctgttgaaggctatgtgctcagggcctttgcagctcccctcccatgcctggctactgtccccttcttctgcaggggctgccttcctttcctttgcaggggtaaaaggatgatgaccaggagaaaggcgacctttcctcctcactccccaactcctgggggttcatccccatcttcctcactaaatatagctcagtttatcaaatggccagttgaatgtcagggaaaatggacccttttcctcagaagtggtggattaattgcttttcctttcacttttctgaggataggcatataatggagcagccgcttggtatgaaatcattgatttgcctcaaggttgagattaagccagtcacttcaaacattttaatattagcaaaaggctttgtgtgattttttcttctctctgctgtgactttattcaaggtctttagatcacaggggctttgacaagtttgtcagtgatcaggggctgccttaatcaagtaagaaaaaaaatcccgccaagacctcctatgcatttatatgttacaggactgtttaatgccagtatctgcacaaagcgtggtgtgtaaactacaggctttagaggatattaattaatacagattggagaatttctgatgcagctcattaacagagatcaatatttaaaacttatgtttgggtaaaaaaaaaagtcatggtaaataattgagtaaaagaggaaatacacaccagcataaaagtgtgtttatttattttgcacaaatatcaccatgagcactaatgaacaactatatttccttacagtaaaataataccacatggagacttctaaaagaaacccattgatagagtcctatagtcacccttgtgtacaaaaagtcatgtgaatactgcaaaaagaggcacatcttgtcatttcaatattaactctccaagaggtttttaaaacatctccaatatctatatgtaaaggttattcattaatattggctattatttggatgtgaatcctagaaaaaatatagacatttttaaagcaaagcatatgcaagtatttctatatgatacattaaggaatgtattgactgaaaatacaccaagataatgcatatctcgtaattcagattgaaggaacttattctaaggaaatgctatacaaatatgcacatacaagatgttcactgatgcagtgtcacaaatgcaaaaacctggattaaaaactaatagcctcagttatgttaatggaaagtgaaatactgtgaagccattaaaatgactctaatatctgaggagaaaaaacctcctcctcattttatagacaaagatggtcaattaaaaaataattaacgaaaaaattttccacttttggggaagccattttattgaatacactcacttatttaaacattcaagaaatactggacgtgtccgccagatttcatgtggttagaaacttcatccccaagctcatatattaattttaagtggggcatttgggaggtaactaggattagatgaggtcatcgcagaggggacaccctgataggactggtggtttcataggaagagaaggagatacgaatggacatgcatgctcttgtcctctaaccatgtgaggcagcaagaaggccctcaccagatgccggtggcatgctcttggactttccagcttctagaagcatgagcccaataaacttattttattaacagattatccagactgtggtattctattatagcaacagaaaatggactaagacatatactgaagagttgatgacaaaaataaatatgtgattttgacacattctatgaggaaaagaaaaagatgcagctcagaatcatagtattgaacctaacataggatgggggaaaaaagcagagaatgtgttgttaggatactatgggaaagtgagaacaggtacacgacaatttgcaactaagaatgttttggactcagagggagaatgcccctggcatcatgtcaaggctgggccacactgagttggggcagaggtggggagacagaactgaggaaaagtggagccaggccccagtgagctggctttaggattctgaattttgatttatttcagttcagtttatatactaaaaggtttgattcagttggttcattgaaaagatttaccagggaagaaatgacacaagtcatatgttttaatttagttatataacataatatagagttgtccctgaggatctgaggagggttggttccaggatgcccatggatacgacggtctgcagacactcaagtccttgatataaaatgacagagtatttgcatatagcctacacacatcctactgtatactttaaatcatctctagatgacttgtaatacctatgacaaggtaagagctgtgctaatacttttcatatttattttaaaatttgcattatgttttatatttattgttattttttactgcttttccaccaagtattttttatggattggttgaatctgcagatgcagaaccaagaatagagggcagactgtggtgacagacaccgtctgtgttatcacttgaagagctgtcctgtgggagaaatgacagcatgacaaacaggctatgtggacttcagcacatcggcacaatgtgcctccagttttttcatctggaaaaacaactggcagtgggtggtaagtgatattaatgtcccttccagttccaagtgcagtttagtgctttgggaatagtattcagagattctcttatggcagtgacatttttaccagtgttaggtgaataaaatataactttatgaaaaaaatggtataaaaggattagtatgttatttttcttatacaaaggaaactagctgaatgagaggcttaagggatatttgtcttttattatgtgaggtttttttgaaatttaaaatatgaagaaccaaaacttaccactaaatcctactgtccagattgcttttaaaagttctactgtgagaggtaaactgggaatctgagtgtgtttccagttgtgtaataattacattgccttattgttttttagccaggtaatattcttatctggaggcgatgtttaatattgtttgaatatctatgtgacttgcagcactatcataaatgagtcttacgacatgcctccgtcattctgatattgtggacaaatgatgttatagctatctacgaacattacatataaagaatgcatattgtcaagattgaattttacctgaggtctgagcccctggaaaacaatgaaaattaaagaaatactcctcatggccgggcgcagtggctgaagcctctaatcccagcactttgggaggccaaggcaggtggatcatgaggtcaggagttcgagactagcctggccaacatggcgaaaccctgtctctactaaaaaaatacaaaaactagcgcggtggctggtgcctgtaatcccagctactcggaaggctgaggcaggagaactgcttgaagccgggaggtggaggttgcagggagccgagattgcaccattgcactctagcctgggtgacagagcaagactctgtctcaaagaaagaaagaaagaaagagagagagagggagggaggaaaggagggaggaaagaaagaaaaagacggaaagaaagagagagaaagaaagaaagaaggaaaggaaggaaggaaggaaggaaggaaggaaggaaggaaggaaggaaggaagaaaggaagaaagaaagaaagaaagaaagaaagaaagaaagaaagaaagaaagaaagaaagaaagaaagaaactcctcacccttcagtgtgatcaaaaacagcttactgccaggtccccctttccccatatgaattagatgtgtcacctaacactggtaaaaatgtaactgctataagtgaatctctgaataatattctcaaagcactaaactgcacttggaactggaagggacattaatatcacttgtacccgttgactacataggacaaggccagacttccaattcctatcctttgcctcaacaatgattagctggattgcttgtccctactgatgaatcagaaatgcttattggttaaatttggtgaaggttctctctatcctcagaaccctgacctcaaccccagccagcagagagcctctcctgagaagaagctggccctagggtaaaaccctctctcatttactatcccatatgtctttcttccaccccactcctccacaccagttcttactagcttgtttattcccctgtataaaagaaagcccaagcttggtgtggtggctcacgcctgtatcctagcactttgggaggccgagatgggccgatcactggaggtcaggagtttgaaaccagcctggccaacatggtgaaactccatctctactaaaaatacaaaaaaaaaaaaaattaactgggcatgatggcacatgactgtaatcccagctactcaggaggctaaggcaggagcatcgcttgaacctgggacgcagaggttgcagtgagccgagattgcaccattgcactccgcctgggtgacaagagagaaactccatttcgaaaaaagaaagaaagagagagagagggacagagagagagagaaagaaaggagaggaaggaaggaaagagagagaaagaatgggagagagagagagagaaggagggaaggaaggaaggaaggagagagaaagaagaaagaaaagaaaagaaaagaaaagccccttttgcctaacccttgagatgcctgcagatcttatggtcagagcattcttctattgcacccatcctcctcccactattcgaatagcccatccctaagcccctgcaataatcctttctaataacgtctactcttactaaattgagatttattttttatttgacagggtttttaatgagaaatgctttttacgaggttagaatagttctggtggttgttccttagtctctcatcacatctcctttatgacttggaaagataaatttagcatggaaaaaaatgtgattattagaaaacaaaaagaattttaaatcatgaaagaaatttatgcaaacaatagggcaagacctagtacataaaaagagtcagtgaagcgaataaaaacaacaacaaaacagcaccaccaccaccacttaaccacaaagtgaaacaatttacataatgatttcttgcttttcttcttcatattattgaaagtttctttgttcatgttatctccagtggtctgttaaatgtttgcaatgcctcagtgctcctctgaacaactttgttaggaatgagaagtgctctacctatcaacaacaaaggcagccgaatggctagaaataagtttgttgaaaatacttcttgggttctgccttacctgtcaatcacaaaaagaaggtggagaaaggaggcatgcttatggcatcccagttttaaggaagaacattttagcaataagcaagcagtcaccaaaaggattcaaaaaggcagtgggtttagggtgctttgtttcactgtgaacatgaactgtcataaatgcatatctgatattttaatatcagatatttggttaaaaaaaaaaaagtgaggtaggagggtgcatttcattatctctcccagatacgtactggccatctggtgggaaagaaaacaggcagtctcagtccagggaccagaggatctcctttgtccctgtacatacacgcaagaacgcacatattacattatccaggtagagagcacgtggtaggttacaaagaagccatgaggaagaaataggaaacctgaattgtagttgcactcctctcaatatcctcatcagcaaaatgaatgagttgttaataattacaattgtaccaactgtcatactttgccatatggcttgtatatgtgtttggtattttaaatctataacatacagtcatgtgccccatctgcatcaatcatggcatgtgtatatggtggtattttgtattttaccctactttttaatgtttagatacaaaaatactctccattgtgttacagttgcctgcagtattcagtacagaaacatgctgcatgggtttgttgtctaggggcaataggctacaccgtacagcccaggtgtgcagtaggctataccatctagatttgtgtaagtatactctatgttgtttgcacaacaagaagattgtctaaccatgtgtttttcagaagtatgttgtcattaagtgacacgtgactatacataaatatgttaatagcttgtaatgaagacataagctctaattctgatcaagcctagacaaagcaacttacatacataattcttaaaataaaaacccaaggaagacgttagtattccttgtttctggaaaaggagccaagaccctgggagttaagtggccttctatgaggccagatgactgggccaggacccactacctggctgaccccaaagttcacccttttattcattctgctgcattggttgtgacctagaatattctgttgtttttctggtttagagaaacagaaagaagactcagagtagactctgaaatgtccactccccacacattgcccagagccactggaggtacaatgtgccaggcacagctgtgtgggcagcaaggcacgtggagcaggaagcaaaggatgatgccgaggcacgggccacgtgtgcagtgcccgaagggggtctcctctggtcgtggctgtgcaccagtgacagaagggtttacttactatgatactggagaccaccatgatcactgacatttccttaatgatgcacaaaatgaagcgcacaagtatccaacaaatgaccagagaaaacgctagcatacttctctgaatgtacacttcagagaaggagggaaatgcttaaatgtaatattttagataaatcactgaatacaattagtatagtaagtacactatggatttgatggtatgtagtaatacgtctctatggcaagctcatctcctggaaaactggaactacatttgtccacaagcctttctcactgagcaggaacacagcttgcaggttggccgactcatctccccagattttattttctattttatctatatttttcctggctctaatttgtttctgttttgttacattttatagattcctacaaacctctttaactattttgtaatgcaagatatttgagcataaatccctaaaagacatattattttatgatgtaaaggtttcattttttccattttatagatgattaaatagaggcccggcatggttaagcggcaagcccagagtcagccatccaacgcagcgcagagctgtgatacaacccacttccactcccacggcatctcggcttcgtgggagttgaggagcgtctcaactgcatgtcaggagaacccatgaaaaggaaagaacccagaacaaatgggtgagaaagttcaagactatgttcagcgtaagagcaaaagcctcctgagaattctgcttgcagcccattcccaggcattacagtgcaaagctaattagggagaatggcatgagtagaagaccaccaagaccaccagctgaaacgggtgttctcatggcctccagtgggctcgactatttttatatttttaatattttggtccaatcactactctatacaacttagctgtcttaaaacaataaagccaaaacaaaaataaaacaataacccaggcctcccagatgttggcttcagtctgtgttcacaagttatcttcctaatataacagcatgagtactacttccccatactgttctcatgagatctatggccaggtccaaggtcacatcatagtaaatctttatgaaggttaagaaatttataacatttgcatttgttcacgaatgtcaataatcccaaccggcaggttttacgctcaggtttgaatgacactttgctaaccaagccattaaggtttgtttcaaggagtcgggggaagctccccagcagctctgagcaaatgaggagccagagaaaaacaattaaaaattttttaaaataagatctttgaaagtatattattaattctatcatccaataagtgttttcgaagactatgcaaatgacatcttgcggtataaaagctgttacagaacagaccttccaacatttctcagtctccttctttccttcccacgcatgccctatgtgtggactggcagcaatgtttttacttttaagaggaatttcatcatttgggaaaaatttagagatattaacgaaaaattgctatgtgtctcatggctacctactgattagaagcaattaacttatttctattttgaaaaattaggctagcaaatgaagcctgtgggagaagcatatttaataaatatagaaatattaattgtaggaagtaacaataacaccatgcaaagttgtcctgtacattgaaaaatcatactgattgtttacctccttattcacagcaagggaatcaagaccatagaagtcaacctgtagctgtataattgcgtccaaatcccagtgaagagtaaatgctaaagcattagggtgaacccattaaaactgagaaaagagagggaaataaatcaatacttaagagtagagttacctaccaaagtaccattcagttcaacacatttggaggcctctttttcatatatgatgagttttcactcatatacactgataaaaaggtgaagcataaaacatctagaatgatgttttgaagaaggtgaaagaatcactgtggtgaagactatagaactgccctgcctccatctctcctaggcactttagccattttactctaaagcagatttggagttgactttttaaatttcctttcaatgttagaaatttaaattagaaaatgtatgttaaagttgattaaaacttaacaagttattctgacccattttcctcttctactgcaattctgtctaatgtcttttatgatgcctttacaattactgttatcatcatcattattattttagtctatcatgtaggaaaatataactggattttgatttccttaagaggttttctacattatttagatttgtgaaagaatgttattgtaagtaaatagcaccaaatcttaaggatacaatatataactgctaacgcaaacagtatttgagaaatgcatctagatattcattactttattaaaaaagacatagaattggcataataaattgctagataaagcaattgagtaaagtgtaatgagttcaagtagagataagatcattttatggagataaatgaattagagaggttgtgattgagaagtgagaagtggttaaagtgttttaagacaaattataatatctaggtcttatccctacttatattgataggcatgatttggtgggaaaaaaagaaacattgtcactttaagtatttccctatcctaaatgaaagctactttattcaagagtataagctaccctaagtttctttattttaaactttgaatgcttcatcacacaaatgtttatattttaatagaaatgtattatgtctgatgatatccaacatatatatacaggctattgaattctatatgtagtaataatcatgaaactcagtgttttctcaattatatcagcaaattctctaacacagatatgccaggttttcttcaactttgatgaagtcactttagttctagtaaagtagaattccttctagaaggaatttaaaagaagctgaatttcctggcttccccccacccccaacaagcacctatataatttatcagtccatatttcaaactactttatttattcaattacaacacattccatggataattctaaaataaactcccacatttaaaattaaggagccacaaaagacacttttaaaataagaaattgcataaagagagaagaaaaaataaaatttttcacaacctacaaattaccaccaagttttacattgagtttgacattcctggtattcagagcaaaatatggacacaaagactcatgcacacactgggtgacctcatttcactgttgtatgtgtgattcctcattctaagtatagaatccaggaggtgcgggtccctttgtccccaccaggaaaatgcagttttccacagtgttaaggttggttacctttttccaatggcagaaaatgcaggccagaaactgagaaagttgctcagttcatacagaaagcagactgcctaacatgaacctcttagtagtcagagcgacatatgctattgaagtaatgtgttcctttattttctaaatggatccttcccaagtaaaatgtacctaagtacataaaccatttagtgggaatacatacacaaagagttgcctcctagatgtaaatgcctcttgaacaacaatcaactattaactcatgcaaaaatattttgataacattttcacaattatctgctaaattaaaggaaactactcacagcaacaaatgccatcaacatctggcagtgaaacaactttgaggtacatctggacaaaaatgactcatgtctaccctcacctgttgcaggctttacacctacagagaggcagctcctctttgccccaacatatttagtttctggactgcattttcgccttctgttgcaaaatggcaatcaaccttattaccgtagaaaactgcatcttcatggtaaggacaaaggggtctgtacattctggaattatattcaacacttacatttacatgaaagagccttgaaaacaatagaataattagacatgtttgtgagataattatgtcatgtaatgatgcctattacccaaagagctgttggttccttaaaaaaaaaaaaacatttatcagccaatcttgcagacttgtaggatctgaagaacagcactgttctcatcagagctaaaagcatatgctatgaatggggtcctccacatggcaatgaccgcaataaattaccagtgtgtgttctgttttcttgagatgggctcaatttatcattttattgaaaaggttccattatgctaatgtcttacaaaatcacattctgctgttgctggaaggtcatgaggggatataaatttttgcatttagaactaagaagttgtatagcagtcacagactccaagggttaataagaagccatcaaattacattcaaggacttatcaatgacagctcttcagcatgctctcctagttaacaaaagagaaaaaggggaatattgttccaagcttaacatcacacacacaaaaatgcttcaagtataaacgtattaaaacttggttttaacacaggttgatcatttgaaaaaaaagtcattgaaattttatctgtcagtgtgaagtatcagtataacaggtacatttaatacgagtttaatagaggtttctagtacatagtactcagtttgtttaaattagctactatcttcaaagactttcaaagataagtttgctgaagatctacaaagaatgcaaaaattaatatgcatattttagtgtaacctcattgtgtctataaggaggataatggagatttttgactagcatcaaatcccacatctcagtgagttcttagggaaaagaaagatgatgagctaattattcaatgcaaattagatattattccttagagaaatgttttgtttccatcttttcaagaattactgtttccttccaatcatgaaggactgtggatgtaattcacgaatatatggtgccatcaatctatcaataatttgcagttatgggcaacaactgtcaaacagctgagtaaaaacacataaaaccagatagctccctttggaccaattattgtaaaccatagaaacactgaggaaaaacagttgctctttagaaacacttggtatatacttggcatccaattttgtaatgcaacctaacaagcagaatgtaaacaacagtaactgcattgctagatttgtcattctgttttgtctggttcagcagctaagtggttacgaatattaacattctacaacatcagtgtaccttaaattcaagaggccattttgaatggatcactgattgcattttgatggaattcccagggaggtgatgagtaagaagccaggttgtggtctagggctgggcacattcaatcttattctgtattaaagtacagagatggagatacacaatatgctctttcctcacctggaactaatttgacagggaaaaaaaaagctttagaaatgggtctaagatagtttggaaacccaagttcacaaaattgtgtttaaaaatatataaaaggattatagaacttcttgacaaattcaaattattatataaagtttctcattgagtagctccaaacactgtcaaaattattttttctgtcagttatgtatgtcctgtcaacaggtatatgcattcacgccaaatgaacaggccatggaaagtagacatctctttatttgggaaaccattactcaaagattttaccaaaaaaataaaaaaagatttttggaagagcttggggtgaagtggttgtttttgcatcagggtatatggaattaatgttgattcttccaaatcatgatgactctaatgaatctaatcaagtacacataaacactttgatctaattcaaagaatatggaattttgaatcaaaagacagtggttccaatcttagcctcaatatcttttagctatgacagtttggccaacaatttcatctttactctcagttctccataaaagaaggaatgataattatggccctaagagataatgtaagtgtaaatgtttcacaaactgttagaagaaagggaaatacttattattctcttgagcgtaaaatattgtatctctctggtgatgtaatggttgcagggagcaaagtatatttaccaaaacattttacatattaaataggactattttagtttcattctcttaataatcaaaaaaaatttgaaacttagaattaaaccaaagagattactggtactctttcaatgcgatgtaggtttattatatgggctattttacaactcggtaggagcagtggttcacttttttccagtggaaatacaaagaatttctgtccagtggagcagacaacctcaaatattatggtttattgccctgtaaacacttgacaagatttgtatctagtctagcaatcttatgctaacatctctttattaaattgcatatttacctatctataatcaagacactaatttttccaaagccttttgaaccaatttatacagcttgctgcttctcacattaagtaataggttgaagaaaatttttgacacttgtacattttatatctaatataatatctaatataatataatataaaatagcaaaacagctattttaccttactggaaattataatttaatggttttagaggtcacgctcaaatggaccaaataaccttcatttccaggaagtttgcctcatggactaatatactaaggaatagttcctgaagtcagacagatcttgaaatctgcaaccggggttctccactttttcccctttttcttttctgaatttgtgtgtttggttttgcttggagcacagactcacaataatctatttccctttggtggtcacagtgattgggaattgccttgatagtctgactggcaatctctggacctggatgacacagctttattctttgttgaataagagacaacagagactatgtgtaagtcacttgtgtttacttatctcttggtgacctcagatcaattaaaaatcatatgcccactggggaggaaaacagctctttgaggtctggactaatacatttttgtgattctctatcttcttttgacgcatgactgaagttgtaggactgaagctataaattctctacatggctttgcgtctacatatctgtaattcacaaaagctgttgcctccgttgtgtgaaatgtttccctgcttgttgcaggctgaattacgtcaaaattcctatgttgaagctctaacccccagcacctcctaatccaactgtatttgattaattataatgaggtctttcgggtgagccctcatgcaatctgactactgtccttataggaagaggaaatttacacaccagacaagagggtatgtagaggaaaccccgtgagaggaaacggagaagacggccatctgtacaccaaagagacatgcctagaaagaaagcaaacctacaacaccttgatcttggacatttggcctccagaaccacaaaaaatagattttggttgttgaagaaaaataaataatgacatatacaaatggaataccggcaaaattcacagaaaataaagcaaactctgagtacttcaagtgttctagatttttagggaaaaatctcctcttatagaaactgcttgctcagaaatccaatcacatacatatggtgaatctttggacaatggaacagttttaataatttgggtttaagaaaggaaaaacttttctctcatttttcagtgttaaatatgtgataaggtttctattttacattttaacaggttggggtttggtttcccaggaaaagcgtacttaatccgaacttctcgtacttctcaaactatttttcaatcacaaaatcttgcattacagtgacataattttaaagttttttgaaaaatatacatttttagctgactaaatagaataataattctggcaagtttttctgtagtaggttcttatatctttatatataacttgcaaacatggattgatcttcagacagctaggtaatttgtattaaggctgaaaacaaaagcaatgataaacagacataatatttagtttacatatttttggccctttagttatacatactatagaatggctatatttttgagtcacattaattgttttagttttgctactttaggagcctgtagctctaaaaattgtactatatatatttatagctttgttagtctgctaaaatgtttgtgtttgacacacagctctcctattatgactttccagtttctttgtgaaatcaaagatcttattttgaatacaagttataatcggatttggtggctgagacttaaatagaagaaacagtaacagaaaaatacaacgatttatccaaagtaatgggatgagctttctttttcaagaatgaaaagaatagggtattttttccctaaagcaaagtgttgttttgtaccagtatatgaaatgacaccgtgaaagataaaacttgagagaacacagcaagttgtggaaaatttgagggaagtgaattttaactgcttttgtttataacacctatgtctgaaaagaagctataaaatatattaaaattcacctaattttgattggcttatttgtgagataaattaagggggaaaatgatctcataaaacctatatttccaatgcattaatgcaaaattaaaagtagtctttttcttagttgaattaataaattcatcttagaattcttaccaaggcatagtaaaaatactatttttcccttttgtgtgatatgaccagaaagcagagattttataacccaccagaataatctctgctttgtgttgattctagcatagtgttagaaaataaaaatctacaattatgaaaggcaaagtttcctcacttgtgaatgaaccaagattccctgcaatcatattacatttaccaacaattatttttgaacacttgttaatttgattaaatcgataattaaaggcacctaggattttattatagccaaacgaccaagtctactctgacaactactttaatttccccccagccccatgatcagatctaaaatttaaaaatatagaccataaaaattcaacaatatactttatacttaaaactggctttaaaatctcccacaggctccctggagagaggagctggaaagccttaggtttgtttcaagggttttgtatttcttaatcacctccccactacagaagagctatggaatgagctgtcaaatcagaaggacgctcagccttccctgggttcagtttgtgtacatgaaatgttatgcacagaaatctgttactaatcgaacattttatgggaagaccaaggagagtcatcagagcccatgctgtccattatatatatgttcttactctccggagaaacattgatcaaactcttataaaatagtcatacactgtgtcacaaagggttattttacactcgtcattctgatattgctggtcactgtagtaattaatccagccttttattagtatcaaactggtttctgtctccatctgatgcttgcctgagaactgtgctataaaccacaggcctggggttgtatcttcagcgtatactcctgtttccagacttctcagaaaggagtgtgccagatactctgaactactgatacttcaaagaatagactcttgggtactggcgttagagctgacatcagctcaacaactttcagactgtaccagggaatgaatcagaatttccaggacttattttagtctggaaatagatgttcttcatgaaactagcacctaacccaagatccaaaaaataacaattaattacacaagaacaaatgaactgatgagttaaattatggctacttattttgaatgtttttagtattgcatttaatgttaatttttatggatatatgaagttctctttcttcttcatcagtatcactttggatataatagactattgcttttgtatataattttttttttttttaagacagagtcttgctctgtcaccaggctggagtgcagtggcatgatctcggctcactgccacctccaccttccaggttcagtggattctcctgcctcagcctcccgagtacctgggactacaggtgcaccaccaccacacccagctaatttttgtatttttagtagagacgaggtttcaccatgttggccaggatggtctcgatctcttgacctcgtgatcagcccgccttggcctcccaaagggctgggattacaggcgtgagccaccagctgcttttgcatataaaatttaaaaaactgtaagtagtatctgatttttagcatccttcgaaaggcagaaagaaatacttttactgattctccttactttttcatgagaacatagttattaacataggttcaattaggatttgttctcatcttaccaggatacaattgaacaaattgattatgcaacaaaggatacacatggagaattatatatgagaataaatctcacttcatcaaacacagcggcacgctagtccggaaaactgacgagacacgtagctagtgcctacgaagcccagtggacaaatcaggtttactacctggctattagagtcctgttcctgagaacttcaagaagaaaggaattcatcccaatttatatatacagtgcaggcaaaatatggtggagagaatgtcttggaattgtttcccgagctttgagaaagaaaagcaaataataaaggcttttaaaagtcaaatctaagattccttaaaaaaaaatctcaggcagaattaattatctgggtcaaattatatggctatagatttgtaaagcaaactcaagcaggcctatctggttaattaacagtctcattggaactatgtaaaaaataaggccatgtttcatctggatgaaaatagcatttttctgtgattaaaacaaaacaaaacaaaacaaaacgaaacctttgtgggctaggtgcagtgtttaacgcctgtaatccagcactttgggaggccgaggcagagggatcaccttgaagtcaggagtttcagaccatcctggccaacaggtcgaaatcctgtctctactaaaaatacaaaagttagccgggcatggttgcaggcgcctgtactcccagctactccggaggctgaggcaggagaatcgcttgagcccaggacgcagaggttgcagtgagccgagatcacaccacaggactccagcctgggttacaacagagcaagactccgtctcaaaaacaaacaaatgaaaaccgttttgattatttataagggggggggcagggaatggagtgtaaaaaaatagccacaacttagaaatgggccaaatagacaactagatgtccttttggtgcagcgttgagcttgttttcctattggcagggagctgtaccactttgtagaggctgagataccttgtacatttttgtttggtaaagatttccatccagtgtaacagataaccccaaagtcaatggtttaatatcctcccatttatttatctctctcacacacacacacatgctagaaagaacttttcctttgatcctttgatgagtacacagaagtacagagagttgtataatgagtaaccatcccccagattcaattataaataatgtgtaactagctggttgtcccacttccactgatcctaagattgatcacatggcatcagccagattcccttcacttatatcaacccattcactttcatctaattgtttcatctatttatatctgttggcagaataaagtaggacttgcaaaatggtgaatatctaatttcgcaatgcatctccaattattgtctgaaacttctctgtaaagaaaaattttcctcaactactagggctatttggttaccttgaaatagaattcttacaggaaaagctagataaacccttattttatttttttaattatcaatttcctgagtttgattttagggctctagttatttccaggagtttctaatgtatttgggttttttagcaaaattatgacttgttaagtcttcaataacttttttgtcttagattacacttgttttcatcttggattatcccatcttgggacactgaatcttcattagcccctgtgtccttcaagtatgtcccttctgatttcataatctccactagctttcaaataagatagccacacaagatacacaaggttcatcttgcatatgatttgtcccaggcctaaaatcttctattcttcaatgattccttgtcttttttagttaaaaacagtattaagagaccacaatctgagtggccacaaacgtactcctagttaataggtttagatgaatgatccagacactctacctgaaaagaggggagagtgggaggatcaggagacaggaaaacactagtacatgaagtgttaaaactggctgctcatcagaatcacctgtgaaaccttcaacatagagattctcaggcctcaaccattatggaatatgatgatcaaaggggagcccaggttatgtaaaaggccctaaggaaatgaagtcactccggggcccactaggcgggagtgctgagttacagtctccaagcagccacatttccagaccttgggatccagtatattagatatgcttagcagttgaagaatttctttcttatcttaaatagtaatacatattcattctagaaagttcatataaaccaaatattcgaaataaaaataagtcacaatcccatcacaagaagaaactgctattaaatcttgcatctgcattttaatattcttctttatgtatgcacatgcataaacggggatatatatggttagttattttttatagagtaagatcacaaactactcagtaatttggaattgaattttgtcatgtggtgtctttccatgccattaaataatattctcaacatcatcttcaatggatccatagtgtttcattttatagaactgccaaacattcagaacctatggttgtacctcttgatagttttccattttttactaatataaacagtgttgaacatccttctagataatctactgtgtatatctgtaatataattttatcataaactctgagagtataaatgactaagtcaaaaggtcgaaattgcattttctcttgtgagaattctaaaataattccctatcagtttaaagtaagaaaagtctagggcacatgaaaagaactagaaatgaagaagcaagtgtgcataaagagggaaggaaacatgctgactcttatcttttagagctgtcacacattgaattttaatgtttggggaaataaccaatgtagctgttaggaagctgtgattcaaacatggtagcactaaacgatacatcactgtattgggggcaggtgcaacataaacctcccatggatatttgtcaggtgaagaattcaggaataaggtttgcctatctgtatatagaattttgaagtcagggtaccttctagtgttgactgcaatggttaagtcatctgtctgtctctgacaaaagagctagaccctgcttcaggaatgcaaacttctcccactgctatggtctgactgtttctgtccccaaataattcagatgttgaaacctaatcaccaatgtgatggcattcagacataagaaatttggaggtgattaggtcatgagtatggagccaccgtgaatgggatacgtgctcttacagaagatgccctggagagctgctgtgctccctccaccatgagagggcacggctggaaggcaccatctatgaaccagcaagcagccttcggctgacatcagctttaaaggtgccttgttctttcacttcccagcatctagaactggaagaaataaatatctgttgcttataagccactgactcattttgtattttgtcatagcagcccaaaggggctaagacacccacaattgggaatcttggatgagaatgaactatatttcccattttcaaaaagcttatcaatgagtgaataaacaaatgttgttttcattcatttaacacatattattaagttagtaagcatcaacaatgtgcccagcactgtgttaggtactgcaacagcccagagtgagaggaaatgcccctgcttcctggagcctgccttccagcgggcagcctaccacctgcgtgtgctattctggtggccaggacgctgttgtctacagtaacctggtaaattaactatgttaagagagtactttttctttcttcacagaaacaagaaaaattatttgccgtggagtccaagagaggagcatatctatcgaaatggtaattgaaagagaaactggaaacatcacctgtatgaaaaatagtggatggctctgttaacgaaacaggcatgctggtgacaacaggcaacaaatctaatctaatctaatctaatctaatctaatctaatctgtttctccataataagcagcaatcatacaacccactaaatgactgctgttgcttgtcactgaagatgtccatattttactgggacataacatttcttcttggcatgaagagaatggattaagcaaatgaataaaagctatggttctactttaccagcacaaatggacaaatccaaaataaataactgttacagcaactatgctaaccgtattaattaaaatatgcaaggtatactcattctcattttcataaaaggaaatcctaaacgctcaatttgaagtatgtttcctcactatttgtaggaacttctagtcctagaattcttggtccacctttccccaagattgtattcatttgttaaatatgagacaccaccaaaattgtaatgatgccacaatgggagagttaatgaagtaaaaaaatattaaatgagtcaactattattaaaaaagaggcaacttcatatccatcaattagaaatcaaagagtctggctggctatttatcatcaaaaatcttttattggtataaaaaagtccacacaataagcagctttttaaaataaccactcaggccagagtatcactcaccaagctgtgactttatgttctttgtaacaataaagaaattacatggcaaacaacaatctgtgaaaactttcaaatcatactttcctaagctatcgctctagattaaaatgtttgccttagttttcagggggttagagaagagtgtcttatctccaaacagaacaacttcatgaagatgcatacacactttcttcttgcagctaaggaaggaccgtctttgactaggtaaagatccatgtatttgaatcatgaaaatatccaaaaagacgggctgggcatggcggctcacatctgtaatcccaaatactgggaggctgaggtgggcagatcatgaggtcaggagtttgccaccagtctggctaacatggtaaaaccctgtctctattaaaaatacaaaaattagctgggcatggtggtgggtgcctgtaatcccagcttctctggaggctgagggaggagaattgctttaatctgagaagtgggggttgcattgagctgagatggcacctttgactccagcctgggtgatagggtgggactccatctcaaaaaaaaaaaaaaaggaaatatccaaaaagacacattagcaggactcagttcccagtgtgttgtttgaggcactgaccctgatctgaaaacagtgctcagttgattcaatctgaatctgtgtccaccgtcttcctgctcacttagaataagagctgtgtttgcattgcacaatgaacacccacttgctgaaagctaacttgttcctaactgcccccatccttcatccactgccagagccagctttgttaagccccctgtgacctatatctgtgacctatccctagctaatcttctctttcaaaatatgaagtggggtacacactcatcgccaaagggtcctttgagcaagtcccagtagaaaatttatccactttttggatgaagtactcaaaaaagagtactacatttcccaacataaaatggaaaacaaatacatatgccatacatcattcagggctggaaaacaacgaaaatgtaacactccagaaaaacagccatgggaagtattattcctcatgccatccatcattatcatagagcacccactattctaatttagctccaaatgtgtggtggaggtgatcaaactttaaaattaagtaaacaaagagattcatacaaaaataaaataaaataaaataaaataaaataaaataaaataaaataaaataaaaaccctgaccccaaaactagagtaacctgacgtctcccaagtatgggttggggacctagcacctgttctgggggcaattcaggcaggtagccctggatctgtaaacctaggtagtattttagagcctgagcacaatattgggcctttgtacatgtgaactagaaagcaaagggataactgaaatggataacagatagtcagcacttggtatattccaggcctttctctaggcccttgtcacgaagtatctgacatcaacttcatgagttaggtactttttccttatctctgtatgagaaatggggaaactgtggcctggtatgtttaaaaacaaaacaaaacagtgcactattcacttgaggatcttattaaaatgaaggttactgattcagtaggtctgatagggggccaatgattctgcatttctgataaactcccaattgctgctgctggcccacagatcacactttggactgcaagaaagtaaattctccgagtcctagaggtagcaagaagtagagccaagacgggctaagttgcttggctccggggcccacacttactgccagtcggcttagcatttgcatggcagacacatcacagcccaggtaccatgaatgcgctcaaggattcaaaatcaatgtctgtcaccctttttgactgcattttctagcaacaaaaattctgtattcagtgcgtagtatataccaggaactgtggtaaacactggttcaaacgattttcatttaatccactgaagtaaattatcggccatttgattcccttcttacaggaagcaaatcacaaccccactgatgcactgggactctagtgagtttaattatcatgcacagaaaagattgagcattaatttgcaaagaattagaatctaataacacacctctaacaccaaaggtagtcaacctttggggattgaggaagaattgtaagatcttacagagcatcagaggtatcatttggaaaattaattatagtcaaatagatgaagaaggtgtaggagtttgggcctgattctgtgaaattatcaaaaagtactctaaaaaagaatgtagtgatattttccttgtcataagggtttcattttctattatataatagatattttattaattctgtttttcttacataagtagaccataaattcttgatttatgtatgaaatgtttggaagctacaggtcatacaaaataacaccttctataaaatttcacaaaatttccattagtccttatttactcagaacaaatttagaaagattgaaaagagtgtattacagacagttaaattctaccacttaatttgaaattttttctttatcttccctttaagaaagtggaatccagcagcctgcctgcatttttggcagactctgcaataattacgatgctcagatgattcccaagatggacctccccagctgtaaataccctgcctccacgctcattcctgtcaagtgcagatctccccatcttggcatatgggcagtgtcctctgaaacacttcagggtttgaagagtaaaagatgtaaatgatttgcttcactggccatgtaggcctccaggagagggacacccagacactaccatttgtagaggcctgtcgttagaagagcacactgtccagccaggcctcatggagtcttgaatgcaatgtctcccttccccttgaaatcacaatatgaccttgcagaggtgacttcagaaaaatcaaaacattttgaggctccctacaagtactttacttaacttcaacaaccaatgctgtcatttctcacctactctcccccacagttactttttatttctttatgtttcaaaacagataaccaaccacaaaaagcaaaacaattcccacagaggcatgaacccaaacaggcacgaacaaaagcacaaggtagacggggccagcctcagcctgtgctgccccggcatggtattcctctccgcagctttttgtcaattgcatgctgacactccttcccgctctatttcatgacatgtctcctctccttttggaagcatataagcaaaaacatggggctgggtgtggtggctcacacctgtaatcccagcacttcaagaggccggggtcagtggattacctgaggtcagtagttccagaccagactggccagcgtggccacagtttttcttttttttttctcaaaagcaaaaaattctgaaaaagtagtataccttgtgatatagttttaaaatctgactacttggctgaaatcaattaacatgactcttcaaaaaggtccattttaagactatatctactttctaaccaaaacatctagaggaaatgcaaaatttcctttcacctgatagctatattcaggaaaacacaggctactggatattttacataagctctgaagtgagacggtccctgggtacggcttgaattgtctgggtcggttcctcaagtggtctctgcagtttcctcatctataaagaggatatgaacatggtctaccttacaaggctgcaaggaattaaaagaggtatttcagggaaacagggtttctatagtgccaggtttgcggcaagcactcaccgacaccgcctgcaggtatggcccgttcgcgatgttctgggcagtgcagcagttctaggatttgaaaaccttccgggttgtgttgcctccaccctttcctcctgcagttccttcacaagcagccagcatgaggcttcctgaagtcagatcatgtcactccattgttcaaaagtcaaattttctcaacagggtcaaatcctgggcccagcagaccctacctgacctctccaccctgccctttttctgacatcctcttctccgagctccacctgctccaagctccaccccatactggctgctgcgttttctgggcgggggcctgcctggggctcacgagttgctgtcgcctctgccatttggcacacaaatggatgctccctgagggtgccctcctcacagtttagctcatcacacaggcctcgcggctgctgtatattacggaactccccaccaatactctttgtccccttgactctgctgtttctcgatagaacacacacttactagctgctccaaatagaatagctccgttgaggtaggcatcttgtctgtttctattttctgctacatcccagtacctggcactgtgcttggcacagagtaaggactcaatcgttatttgtttatgtagttcgttaactgtatgacggatattggaggagcctcctatttttttgctaggtccaatagcttcatctcatctgtcaggagatgatgaatggcgcctcatttaggaaacaccaataacacatgaaggtaatttacacacaggcaccctggagcccaggtgcagctcaacgttcttattgaaaatgtagtaaaaatagattttattcactgaccatattttaaggaatactattttttactatttcgggcagtactactcaaagcacagcccctgggcccgcggtgttagcatcacctgggagcttgctggaaacgcaacttctcagcttccatccaaggccaactggtctgggcccagtcatctgtgcttttataggtcctcaggtgattctgatgagcactaaagcttgagtggcactgctgtaaaaactacttcaatgactcgttccagttctttgacgtcctcttacaagtctttagtgtgacatgcttgcgttcttagtaccaacagtgtaactggttcttcatgtacatcatgttatcacctctcatgttgaccacttatcttttgccaactaaaaatacttgaaaggcaccttctcgggtttcagaagtttccatttgtttcgacaacatatgaggctacagcccagctattcacccattagagccctcccacgtccagccagcacttatattcttcgaagttaaaattgaagactctggaagcacagaaaattgggatttcttttaatctctttttctgaggcacaggttttcaaacattgtataaccaaggatttttttcatcttttcaaatgatagatgttttatgtgtttaatatgtgaagtacgtaaagaggaatggtctcaggctgctgtgattggcttggtgtgttcacctctcaccgacctgcctctgttctcccacccagcgtccgattgttccgtgagaacaacaggtaggatccataattgtaaggctggaaaaccttagccatagggcagagtttctcagagtatggtcagtaccaacattttggggcctctacccccagacaaatacatcaaaatttctggtcacagaaaaagaatgaaagaagattttttttctcgccattctggccatcaaagaaacatggaaaaacatgcaagataattctgcacatgagagtctgtgaatctctgctctagtaactttacgctatcatttttagtgaagaaaaataatcatataggcatactgtttgcatatagtcatttcaaatcattccattcagtcttaactcaaaccaagaatgaaccaagacatttgaagagatgaaatctcaatttctctgtataattttaaataaagcattcgctctaaaagctaaatgcacaggagttctgttgaatgactgactatgtttacaatttgaagcaatttagtaaacatgtatcaccactcttctaagagattttggggaaaactacagttaattggacaaaaactccatcctcaaagagattaaaaggtgaagtcagaactggagtacaaaatagcaagtaataagggagagtcctaagagttctgaaaaggattccctccagttctaatgagcaggagaggattacttgtagtttagctgttagtttaacacagagttaaatctgaaagttgacctgggatgcaccatctctcttttcccaatctttacagatgcaacatatctttacagaggccttttagtagcagcatgtagggtgccaggaagttgcccccagtgtgtagtggtgcagggagaagtgttaggatggcaaccctgcagcccccaactgcaccatgtagagttgcctgagccagtccctagcctgccaaaagcacaaggctggcaggccacaagacagaggggtaaatgagaaacagggtgatcagaggttagatgtgactcagacatgagtggaaagtcaaggtgaaacagcgcatcatcatagatcatacagtactctgaaggctgctgtcatttaccacattccataaatttactagaatttattctctattgtttgggttgaaataatcacacatttcaatttaaaaatataaagagaatattagacatttagcagaattttctcagtgcctactggtacttcagaccctatatagagagaatactatattttcttaaaatattatggtctagagagagagagagagtcagttgaaagtgtcaataattctaagttcattctcataaaagaaaattctggagaagaccaagggcaattttatgataaaacaaaataagaagactaaaattttcagatgaatatggttgataagagagtagagccagatgcactaggaaatgtattaaagaacatgaatatgtacacaacaggattcttgtgctcaaattgtttttaatattcagataataagtaaaggtttaattttgctctaaacaatgtgatttttttatttttagtaagaattttattttgggaaatcaaattaaagaactagtagataggtctcctaacataataaatccaatctgttatacagttgtacaggaacaaacatagtaaatatagggtttggtaccatttttggtttcaggcgtacactgggggatttgaaacgtattgcctgttgatggggagggacaactgtacatgtgagacacccagaaaaaatgcataaatctcaaagaggtgcctaaaattcaggcttgaataccatcttcaatggcaaaggaagaaagggagaggagaagacaagagtaaggtttgttaggcagattattcagttggtgccttctcaaggatcagagtctccagagactctgtcctcctcatcctagtaaggagagggagacacccttacaaatggagacttccttggtagatataaatttcccttacaaaagggtcacttctactctgtttttagagcttttcctgtgtctactgtttctcaaaataatcagcttaaaataatacttatgctaaagtggcatattttggggtggcatattctggtctcatacacactcaaggtggaattttccattgtttggtttataatgttggagcatgagtattctctagaggtgtcagtgtcagaatgatcttatacatactctggttgaaacgtcagaattgttatgggcttgggttcgatatttatattaatatattattctggtcacaagagtattgcaggggtttagatttatctcatttttccccatttttgacatttatttccatttctcaatttttctttccagacctgaggtgcccagctcacatgaagcagagcctctttccctcccacaatcatctcaagatcaccagagcatcagttaatgccttactttctgggcttatctactcctgtatttaaagatgttgtttctacattttcacttgtccttggaaattatctttttttattttttgcaagatcatcgaaaatttttaagttccttaaattttatttagtaagtttagtaggaggcatttcttattatgttaggcttccatcttgcaggccccagaactttctgacactgtgaaggccataccagcccacaactgccaggatctattgtatgtgggaggaaaatcaacttctaccctgtaaagtcattgtgattattttgtgtcttctgtcaaacacagtaaaaattaattctattacacctttgactatttagattagagaataaaagactaagaggcacatattaatttttttaaaataactaaacaataacaatctttgccaaagaaaagcattttgaaatgggtggtagcatagagagaaggaagagtcctttcacactaaggatgtcattgccattggcatatctggctttagaaactacaaatggctcgattagctttagagttctttctgctttttagaatttttctacatcactagaaacatatctcttatatttaatctcaatatgaaaacctgtttcatagtacttacaataaatgcattctcaaatgttacatcaaagtactccacctacagtgatgtctccttgtagtgaattagagactccaatccaaaacgtatcataaactaaatatgcacccggtgaggccatgctccatgcagactgcactaaacaaacaaacaaaatgctttaataatcttagagcattccaattacctggacttccagctggtggtgagtccttcctgctgtcagtgtgcagaatgacagccagccccacagagtctcctgggaggactgagctgctgaggtccacccgagtcaagctctggggctcccgctcacagcctcccgccgcgtttctggggtcgtcgcctccagttgcattcatttcttgaccttttctccacggtctctgcacaatgtgaacaatgctctgctgatccaggtcacaattctgtttgggagcaaggtaaaaaaaaaaaaaaaaaaaaaggaaatgtcaaacatgaaatgcgagatagagtttaacttgccctccgtggtagaagggaagcaaaagtgacatgtaactgaccaacttaggtgctcctttgcccacagcagttacacactacacacggtagacaaacaacactgaactggggccagaaacagaaatttgggaatacgtgaaacacaatagaatgctgacgtcatattcaaaaggacataaaatctagcaggaaaaaataattaccaaactggatctataagcacagtgaaaacaataattccttttttccccccaagacagagtctcactctgtcatccaggctggagtgcagtggtgtgatttccgctcattgcaacctctgcctgccgggttcaagcaattctcctgcctcagcctcccgagtagctgggattataggcgggcaccaccacacctggctacgaaaaatattcttaaatagtaaaactgattgacatcagaattgatatgtcattcatctctgttttacaaaagtacagaaagtgagttattatcaatgagagggcatttctttaaagcatcggaaatgaatgcgtttgagtaggctccacacacaccgctccacgggcaccaacacacacatcattacactggtggggaagcaagacaggagcacactcttgccacccagggttcattctctttctgacgatttaaccatgaaaaccagctaacatttacgaaaaggttttgcatctacatattgacacgtaggaacagaagactttaacattttgtagcataaaaattaaaagtcagattatttgctagcacaagaactaggctaccctaaatggaattctagtttcagaatatctactacatagggccggccgcggtggctcaggcctctaatcccagcactttgagaggcctaggtgggtggatagcctgaggtcaggagttcgagaagagcctgaccaacatggcaaaaccccatctcaactgaaaatacaaaaattagctgggcgtgttagcgtgcgcctgtaatcccagctactcgggaggctgaggcaggaggatcacttgaacgccacccccacccccccaaccaaaaaataatatctactacatagaagcagttactcatatgcttgctaccctcttaagacacagcaaggaccttactctctcagtaaatcgatgtggccggccgcagtggctcacacctgtaatcccagcactttgggaggccaaggcgggcggatcacttgaggccagtagtttgtgaccagccagggcaaaatggtgaaaccccatctctactaaaaatacaaaaaaaattagccggctttggtggcatgtacctgtaatcccagctacttgggaggctgaaacaagataattgcttgaacctgggaggcgaaggttggagtgagccaagatcatgccactgcactccagcctgggcaacagagagagagactctgtctcaaaaaataaaattaaattaaattaaatacaaataaaccaatgcctttcaaatacctcttgccattgtcattttaggaatgctccaagaacactcaagtgaaatgcatccataactcatagcgatgaatgatgcccttccctgctgctttctcaagctcttctgttgccctcaccatcaatgtccctcgaacagtggtgcccagcactcaccaacacccctgaccccaaatacaatggctagaatctgcctcctccacccaggagggcaccaggacacccttcgtccttaaatcccattccaacctcttctctactcttacaccctggggctccgtctcatccccaggccctgtgcccctccccattctcagagctcccagtctctccctaggactgctcctactcagcagaggccactgtgcatcattctctgacctgaagtgctcccctgcatgacttcccagtttctgtcaaaggaaaaaccatcccccacatcacccgcttcgagccttcccctcccacctaaaaatctcattatcctcccatgttttgtaacgggctgcaagagaatcactatcttgaattcctcctacctaatctttgacatcggcaaggcaccaacagttagcaattctgtctcagaattacccttcacatcttcaactcttttacatctcaatagtcacctccccgttttaggccttcctcatgataatagctttgtaattactccccacatctgatatcgccatactccagtccaatacatacaagaattctgggtgtgtgctacataatctttctaaagtgtctcagtattacttgtaaaatggactgtaacatctcccatgttcttcaagtgtgtttgtacttttttcctttctaaatcatgatctagatttgatttttcatcttccttacccctcctatatgatacatgtggcagattaaactattcttcaaaatcatgcacgcctgtacattagtgcgcatacatcatgctccccacttcctccctgcaatctgtgtccagccacatgaatggctttggccaaagggatgttagcagatgtggttgaaccagggccttatatttgtcccgctgctaaggtccatcaaaagaacatccctgccaggcacagtagctcacccctataatccaagcactttgggagactggggtgggcggatcacttgaggtcaggagttcaaggccagcctggccaacacggtgaaaccccgtctgtactaaaaagataaaaattagccgggcatggtggtgcgtgcctgtaatcccagctactcaagaggctgaggcaggagaatcacttaaacccaggaggcgaaggttgcagtgacctgagatctcaccactgcactgcactgcacagagcaagactccgttgcaaaaaacagaacttcccagaaagcttctacctgttcacacatggcccagacctgagtccaacccactgaggtgaccaagtgcagccacactcacagcatgaagcagggacccgcagctgaagccagcctgaggccgcgggcaccctcgctgacctgtaggcacatgagaagatggcatacttttatggcactgagatttctgcttgtcctctaatcaataatggcagacagtcctctattttccattctatttggacaagctatcactgtccatgatcagctccgtgtcaggcagcactcctccagctgtgcacagcctctagcctaagtcgtttcagagaaatgggcatcaggatccgagtatactcaaggacttgcacaggagcatgtgagctttgccacagaaggaaaagtggagaattagcaccctagcctatcttgaggtttctatccacattttttccctacctttccatgttcaggactcagttacttcctgtgatcctcctagagaaaagtaacacctttctccctcatctgaatctaaaaatctttgcttactgtgctcttcttattgcagtggttagagcttggacagtatatacatatatattgtgtgtgtgtgtgtgtgtgtgtgtgtgtgtgtgtgtctgtgtctgagtcttatcttccaacttattttagaaatacttgagagcagcaacttggccatagtagcattcatcagaacacctcacacagtgctttggagccaggagatgtagaaacatatctatgaattctaaaagtttgaaaaagtgaatgactgaagggaagtaagaaagaatgaaggagtgaatgaatcaatgaatataaacagtcataagctcagtgcccaaagtgccacagagggaaccagcagaacaagaaagaaaggacacagaatttaaagtcaaacggactcaagctctacataatttattagctgtatgaattttggcaaatgattcttcctttcccagctttctgccattgacaataatatatcaactttgaaggctgttttgaagatttaaggaaatgtaaagagctcagatcccgatccgcaatgatacatcgttggtagtattgttaccatttatgagtttcagaaaactaaagaggatgggtccctaatcttgtacatgaataaggtgtcagaattctgtttagctgcacacttctgtttggaaaatatacagagaaggcagaataagcagaagctatcaatgtgacaatctctctggtagcattccaactttctgtgaactaaaaatcgatacaaaaaaataattcctatatcaccatatagccagatgccatgaaacacgtgaagaacctgagtgaattttcagggacaggtaaaatgtgacaaatgttgatgaaatctaaaagatttcaaatccagattttcctaatgctcagggtacagctgcaaaggggaaaagaaagttctcaaacagatttcagtagttacagtgatacttataggacgcatttccctcagttggcatccctgtttctgaaatcattaattgcttaatctttgactcttacagaaaatcttcttggttccagaagcggtgcctttgacagacagtggactcacacaccacactggttcagttcaaagccacattccatggacagtacattggatacagtccagttgtacagccacgcaaaagccccaaatactacttagttctcctagtatacaaaaaaattcctcagatgtgggaagaaagagattttcggtgggaagacatcagagtgctccaatatggtttcaggctaccttagagcagaaacaatgtcttatttatctttgtttctccaataaataaaatattacctgtcaaagagaaaacccttaatacaattctttctttttttataacaatatattaatccaacaagtaaggcagtaacaaattcttcagtgtagacaaaccaagtaggtatttctgtaaccgggtttggtcttacactgtcaagcacagctgatgacccatgggagactgagggatcagtatcttgggctttctgtctataggatccttgacatggaaacataccagtattaacaaaacatccatgggagttttttttgccaaacaatgatcaactctcatctggttggacattatccaataatatacaaaaaactgatgtatttttctttttccaaaaagaagttccttcaacggcacatagttaagatccaaatatttcagattcttccaagcacttaataaagagttacaaatatcatctctaaaatgattaataatgagattctaaaattgttaacaataccacattattaatacattgttttcaggagttatgaaaatagttatgttaataataaaaaacatatagaatatacttagccgtatattgcagaccattacaggttttgagacataataaattatttattattctcacactctgatgagggaataactatcaccatctgctatgtctcaatgtgtcctcaaaatttatttgtttcaacttaaccatcaatgtgattgcatgaagaggtggagcctctagaaggtgattaaatcatgatggggcagagccttcatgaatgggattagtgcccttataaggcagtgcaagtgactttctgtcctttttgcccttttagctcttcccctcttccagcaagtgaagacacaacaagaaggccctcaccagacactgaataccaacaccttgaccttggatttcccagctttcagaattttataaattgcccagtctcaggtattttgttatagcaagacaaagaatacaagacaacatacataaagttagtgtgtaaacagagctagaaatagtgtgtaaatccaagagaactgtgcctggcacagataatgctgttttacagattacttattgtggttgctgttgattccactttatagaagacaaaggggagccacagagaagttcacgatgggttcaacaacacccagctcccgagtgtgaagccagggtaggaacccaggccatcgactcctctgctggtgttcattgactctgctgagaggaagtggagacttggatgaggcagacaaactaggacaagtctacaggggcccatggtgaagaccagggtttggatgctgcaacggaaccaccccaggtacgaaggaatgattcagagaagagccagatagctgaaatgttaaaaacatgagaagacaggatctgggacggggctgtataggaggtagcaaagtaaagattagtccagtgtgattttaaagaggaaacaaaacaaaacaaacaaaaaggatgaaagtaagaacaagtgggttgcagaggaatcagtgagagtatggaaagtgaaaagaagatggtataggtgagctggtaacacacctcgcagactccggatgctggtgctggctcaaggtaaagtctgtacctctggagatcccgtcaccccagggaagactgcacttatcacgtcgtattgtagtttctttgtatgcgttgctctctgttaccagacaataccgtctttaagaaaaaatactgcaactgtgtctgtagtacctactgtagggacctgttcataaaacacactcccctgtgtctactgaatgactctatgatcctttaagcacatacctagaagtgaggaaacattccagatggcgttagtaacttacccaagtcaagtctgatgcataattgggaaatgaaagagccaggcctgcagcctcagttttctggctctgagcccaatgctctatttcaaacatcccaccttggattgtccacctctctgtgctcacgacataagtagacatgttggcagaagtgcccagccagtgtgcttttatcagcatactgatcagtctatactcattggcatacttactgtaccactgtctatggtctgtaaagtaggtagggctgtcttcaatatcttcagtatcattcattcattttcagttccttctaaatctgttaaactctatttcctcatacaaaatgcttaaaatcatttcagtgtatggccaacaaacatatgaaataatgtttaatatcactagtgatcagggaaaggcaagtcgaaaccacaatgcgataccatcttactcctgcaagagtggccataataaaaaaatcgaaaacagtagatgttggtgtggatgcggtgatcagggaacacttctacactgctggtgggaatgtaaaccagtacagccactacagaaaatagtgtggagattccttagagaatctaaaagcagaactaccatttgatccagaaatcccactactgggtatctacccagaggaaaagaagtcattatacagaaaagatacttgcacacgcaagtttatagcagcacaattcacaattgcaaaatcgtggaaccaacccacatgtccaccaatcaatgagtggataaagaaatcgtggtatatgatggaatactgctcagccataaaaaggaatgaattaatggcattcacagcaatctggatgggattggagactattattctaagtgaagtaactcagggatggaaaaccaaacattgtatgttcttactgatagatgagagctaagctatgaggacacaaagacataagcatgatacaatggacttcagggacgtaggggaaagggtgggaggggagtgagggataaaatacaacatatatggtgcagtaggtactgcttgagtgttgggtgcaccaggatctcacaaatcaccactaactaacttacgtaaacaaataccatctgtaccccaataacttatgggaaaaaaatcatttcagtggaaggctgtcaaactttctaatgtgtaataactttacattttaaagactgaacatttctgatttttatttggatttttaatagactacattttctatctagaaaaggaatacaatcagccaagaatgatcagactaatttaaaaatcaatagtgttaacagattctaatgttaaaacatttttacattgagttctttcttaaataactttgaagacacacttttaataacaccttaaattgtccttttttgtgctgaacaatcttggcattctttctattttttgcttcttctgaaaataacttctaacaaacagatttttttttttttaaggcagggtctcactctgttacagcccaggctggagtgcagtggcatgatcaaggctcgctgctgcctcgaactcccagactcaagtgatcctcttatggcagcctcctgagttgctgagactacaggcacacgccactacacctagctaattttctagtttttttttttttttttttttgtagagatgggatctcacttatgctgcccaggctggtctcaaattctcaaattcctgggcataaatgattctcctgccttggactcccaaacactgggattccaggcctgagccactgcacctggctttaagcagatgtggttggaagcccatcacagtttttaataacgtattttctatgccaagaaaagacaaaacggcaatgatttaataagttaggccgaatgcagtggctcacgtctgtaatcccagcactttgggaggtcaaggagggcagatcacttgaggtcaggagtttgagaccagcctggccaatgtagtgaaacccgtgtctactaaaaatacattaaaaaaaattagccagacgtggtggcacaagcctgtaatcctggctacttgagaggctgaggcaggagaatctctcgaacctgggatgtggacgttgcagtgaaccaagatcgcaccagtccactccagcctgggtgacagagcgagactccgtctcaaaaaaaaaaaaaaaggtgttatttaaaggtgttttttaatgtaatggctaagaactattttgtttggtcactgctaacaatgaaatgtgtttcaagacaagatgagccagagatgttcacagtaagtcagaataatcaaaaagggaattgttcccagtgatattttttcacttgaactccagttcccctccatagttttcaatgaacactaaatgccaatttatattaattggatgagaacagaaactatcctttcaaactgatccttcatttaaaaaaagggggacttctaaaagatgaatatttgtgatttagcctttcaatttatttcacatttcttatgactgattttcattatgatcaaaaatattatgctgtgtaaagatactgaaaggccccttctctggttcccaaaggcaggcaatacaattactgtgaaaggtcaattagccccacactaattagccagtgcaggcctgggccttgtcacctccatgtccctcccaccacaggcctgagacctttctgctgctcatgaggatcctacaccagaggggctccatagggggcgggaggggggaccgctcaggaatcactcggtttggctacatgccagcaactgcagtaagtgatttagttttgaagagcagaggacagtgctgtttgagcatgtagggtcgggatttcacttctctgggttccctctttcatgaatacaaaggatatcggatcaccaaagctatgcccattaaacccactttaaaattgtgttttatattgtcaacattgcaagaaatgcctcaagtatcacttcttttttctttaagtattattttattactagttgtgataaatattatgaacactttaaaatatatatattttatttgacagaattaaattaatgtttttaaagccatggaatacgctgtatagaattactggggtcagggtttgagagcttaacaacacacgctcttgatgaagctgacccggaaactcaggcacgtcggggaggtcagcactacccaacagaaccacatgcgagtttatgccacgcttcccaaattccaatggttgcgattaacactcaaaatcatatacctccgcgattgcaaaacaacatctgcgcaaggtgtttactgtgggattatttataatagaaaattatgggctgggtgcggtggctcatgcttgtaatcccagcactttgggaggctgaggtgggcagatcacccgaggtcaggggttcaagaccagcctggcacacgtggcaaaacctggtctctactaaaaatacaaaaattagccgggtgtggttgtgcgtgcctgtaatcccagctacaggctgggaggctgaggcaggatactcgtttgagccgggaggcggaggttgcagtgagcctagatcgggccactgcactccagcctgggtgacagagtaagcctgtgtctgaaaaaaaaaaaaaaaaaaaaggaaaaaaaattttcagaaacaagtgaaatgcttgaccatagaagacaagtacaatctgtgaagaaaaaagaaaacaaagcagaaaatagaatatagtaagggactttctatgtcaaaagcaaagaaaattaagtacatacaaaagtagctgtttttgtaaaaggaaacgtagaaaggaaaatcgaagttagtgaaaatggttacctatgagggagtagggaaatgggttaaagggatcgaatgggagccatgtttccctaacgtgactatctacagtttcaggtgtgaggcacagaaaatgtttcacaaaatcacaacaatacttactaaataaaaaggagaaaaaaagcaaactctaaaactgaaaattaccagaaacatattgagctgacaatgtcagtacataaataaaagtagttcaagtaacttttggacacagtgctctgtatatcctttagtacaaaaaaaggaacccaaaagaaattttgtactttatttactaagttgattactggtatgatataggtgtaggaattcagaaactatttgtatttatgttaagatgaaaaattactaaacttactgatgtttttggaaaccgagtttttcacagtggctgaagaaggtgagaaggagcttcatgatgttggagttgaaataaaggaaacaaaatgtacttatgaatttttaaaaaatccaattcattgaggggaaattactcacctatccagaagttgcagaataatgagacccatgtatatctattcatcaccttattcaacaattatcaacttgagtccaaccttgttttatcagtatgaattatcatggataaatgatattatcaatatcactacccactttcccttcctatattattttgaggcaaatctcagatatcatattatttactcaacaaaaatgatccatatgtatctctacgaaggaggaattttcctataaaacctaactagaataccattagaggaactgaaaaattacaaataagcatttaatggcatcaaatatttatgtgtccataattttaattttttccaaatctgtttgaatcgagatccaaacaagtccatattttgggactggaaggaatgtatattatatcttcttgtaatttaattaattaatttattaatttattaatgtatttatttatttatttattttgtgagaccaggtctccctctgtcactcaggctggagtgcaggcatgatcagggctcattgcagtctcggcttccagggctcaggggattcctaacctcagcctccccagtagctgggacaactggaatgtgccactacatccagctaattttttgtatatgccatacagacagggttttgccatgttgaccaggctggtctcaaacttctaggctcaagtgatctgcctgcctcagccttccaaagtgttgggattacaggcctgagctactgtgcctggcgttcaatgtttttttattaagacataactaatatattgtagttctcccttttaaagtgtataattcagcagtgtttagaatatttgcaaggttgtgcagccatcaacactctctaatttcacaacattttctcttcagttgcttttacaagttccctcacccatctctcttcctgtttttacaattaaatttgaagaaaaatgggttaatccattgtagaatttctcataatctaaattttgccagttgcatatgggtggtattactgaacaagtttcttcattgtccttattatagaaaattttatatttgtggccaggcacagtggctcacgcctgtaatcccagcgctttgggaggccgaggcaggcggatcacaaggtcaggagatcgagaccatcctggctaacatggtgaaaccccgtctctactaaaaatacaaaaaattagccgggtgtggtggcaggtgcctgtagtcccagctactcgggaggctgaggcaagagaatggtgtgaacctgggaggtggagcttgcagtgagtggagattgcaccactgcactccagtctgggcgacagagcaagactctgtctcaaaaaaaaaaaaaaaaaaaaaagttatatttgattctacaggcttgactaggtttaggcttaatatgttttgctgggattcctgtaagggtgctgctttgttcttcaagaaggaagcactatgtgactatgcctgagtctgactacatttggctgtagtgtatcttctttatggaagatacgctaaaattgtaaaatggtgatcttttaatattatcacttcttctcaaactattagataacatatttctatcaagataaattttccctcaatagctattttgttactcagagataaattttgtataggaaggcagaataaatgctctattattttcttggtttatacattttcaaaataagttgactctagcaatgaataaaaatgcaatttttaaaagcattattaaaaaattatagaaaaggccgggtgcgaggctcatgcctgtaatcccagcactttgagaggccaaagcaggtggatcacttgagataaggagtttgagacccacctggccaacatggtgaaaccctgtctctactaaaaatacaaaaattagccaggcgtggtggcggatgcctgcaatcccagctacttgggaggctgaggcaggagaattgcttgaacctgggaagcagaggttgcagtgaaccaagaccacacaatcgcactcctgcctgggtaacaagagtgaaaatccgtctcaaaaaaaaaaaacgaaattacagacacacacatattaatgatgtccatcgattgtacttattattttgattggtggttatctatagctaattggcacatcttagaatgggatcctgaactgtggcagaggcgcaagagtctttggtagcttccctgccatcctgtatgacaagagactccagtctgctttgaacactttttgttctagacctgtaataaatcattttgacaaataaaaatggcatttaaagatgacgatgtggatggttagagatactcattgctagtggattcataaacgtctgtcagctttttcagtgacaagaggtatgttttgttcgttttttaaagataaaatacatcacgagttcaatctgatatttcccattcaaaccgaggagtagagggttttaaataatctccttcgtcttccatcttaatcttcttttctcttgttcaaaatcgtgaaaatgaaatgattagatgtcacataattactcattattttagactacattatatacacaatgtgaatgataccattaaattgattactaatcatagtttaagtttttctgcttgtagttctttttgtcttgggatgtacctcattaaagatgtatagtcaaactgctgtattctaaagtcacttggaataatgtggctatgattacaactaaagatacttgcattcatttttttgactttattttttattcttagaactttctatttaaaatatttaattctgttttataattatggaaaatattttcaagtttctaaagtcaaactttaaaaacataaaatt

SEQ ID NO: 1123 - DNA, 242847 bp, Homo sapiens; identical to SEQ ID NO: 853

SEQ ID NO: 1124 - DNA, 2560 bp, Homo sapiens
aaactacaatttctcacaaattctctgctcttgccaaattttgttttcctcttttagcccgtcggttccgcaatttcgggcgcaaataaagaccttctggcatttagtggaaagagcctagttgagcacgatccgcagaagcggaatcaggtggctttcggataggcagcgagatccgaggactaaatcccgaggtcttggcgagcaagcagctgccctccgccaggcatcgaggagcgagctgccgccgcgtttctgtcgcggcgccgcggccgaaccgggtagaggtggtctaccatcggcccttcgtggtgggcccaggggtgtttccccgggcaggggagctgactgcaggccaggggcgccaaggccgcggtgcggtgggagcagagggcagcgcagcggggctggacttcatcttcccacgccagaggccgaggcctccgggaatcgcagggccacctcttcaaagcccttggcgatcccagttctgttccccgagggggctggcgaggtgggcggggcgggcaggcgagactaggtctttccctgtttggcctccgtagccggcgccggcgggtcgttctgtttgaatgaatgatcccagcagccgcgcccaatgggcgtccacgcctgcttaatatgcatgaggcccgcagccaatggccaggcgaggaggctgttttaaacggcagagcccgctggccaatcaggcggctctcgtggaggcagctagcgcgaggctggggagcgctgagccgcgcgtcgtgccctgcgctgcccagactagcgaacaatacaggtacgtctcgcaccgcccgctcccgccgccgccgccgccgccgccgccgccgccgccgccgccgccgccgccgccgcagcgcccgcacaactttccggcccgcgccgccgtgagcgcgccctgccgccgcctccccctgcctctactccccattcccttcccgccccctccgccttccctcctgctaggcggccgggaaggaagaagcaattcaggtgtttcaacttttccaacgcgttccccgagctccccgctttcgggggtcggccccctcggcggacgcccgcccgtggcggccccaggggccgcagccgggaacccagggcccccgaggccagatgtttgggcagctgcggctgcggcggctgggcgagcagaggggcggctgcgggctgtgggcgctgggcggcggcagcgggaagggggccgggagttccccggcccgcgacggactccgctggggaacgggcggccggtgcccgccgggggctgcgcggctggtgcccgccgggggccgccgcacgggcaaacttcgctcccgggcttggcccggcgccgcgcgggcccgcaggctacgccgctggctctgcgttaacatggccgtcgcggagcgcccggtggcccgggggggcgcgggccggccgcccccctctcgcctcccgcccgcccggcgccgccgccgccgctaacatggctggcgcggcgctggcctccggcgagggcaggggaggcgggcggagcggtcggcggggcgcccggcgggctccggcctcggccccggcgcccgcggcccggggcgggcggctcggagggccgggggcgccgctgcgggccctggagcggccgagcgtcatggctgcacgggcgcctttgttatcccgaggagtgcgccccgcgccggggggcggggaggtccggcccgggcccccgagcccccgggcggcccgggcggggcggggcggggcggggtgggggccgacgggcgggcggcggcggcggggcccgggccgctttgttcgccgctgtcgccgccgcccgcgccggccgcgcgcggatcagccattttagcgagtgggactccgaggcgcggcggacgccgccaccagtgccgcggctgccgccggcccggccgcacaccccccgcgcaccgccaccgccgccgcccccggccccgcgcgtcccccggggatgacagcggcggatttcaggggcactttctttcatcaggaggcttttgacaaaatggaaggtgaattacgggtgtcccggtgacccggcacgggggccgaggcgggctgcctgctgccggccgggactcccccgctcccggtcccgccccgcccgggccgccgctgcgggtctctgttgggcagcctcctgggcggctgctgccaaggggagctctttagttttacatgatgaccttgggtgtgggaaaaggaaaagatggcgggaagctggggggtgggacagggacgatgacatgccgcagctgcatttttatttggaaactttggagaaagtgttctcggctggacctgcattctgggttacagatgagcacgactagccctttttatacaccctccccctttagatagtgacgaagtgatgaattgaactaatagtacgggggtacctgctcactttccagatctcccgtgttgtaaagccgtttttttagtaagccaaaacacatcaacaatagtgacaatttcagatgtcccctacgtatagttctcctgctttggtcttgtg

SEQ ID NO: 1125 - DNA, 2662 bp, Homo sapiens
gggaaggaagaagcaattcaggtgtttcaacttttccaacgcgttccccgagctccccgctttcgggggtcggccccctcggcggacgcccgcccgtggcggccccaggggccgcagccgggaacccagggcccccgaggccagatgtttgggcagctgcggctgcggcggctgggcgagcagaggggcggctgcgggctgtgggcgctgggcggcggcagcgggaagggggccgggagttccccggcccgcgacggactccgctggggaacgggcggccggtgcccgccgggggctgcgcggctggtgcccgccgggggccgccgcacgggcaaacttcgctcccgggcttggcccggcgccgcgcgggcccgcaggctacgccgctggctctgcgttaacatggccgtcgcggagcgcccggtggcccgggggggcgcgggccggccgcccccctctcgcctcccgcccgcccggcgccgccgccgccgctaacatggctggcgcggcgctggcctccggcgagggcaggggaggcgggcggagcggtcggcggggcgcccggcgggctccggcctcggccccggcgcccgcggcccggggcgggcggctcggagggccgggggcgccgctgcgggccctggagcggccgagcgtcatggctgcacgggcgcctttgttatcccgaggagtgcgccccgcgccggggggcggggaggtccggcccgggcccccgagcccccgggcggcccgggcggggcggggcggggcggggtgggggccgacgggcgggcggcggcggcggggcccgggccgctttgttcgccgctgtcgccgccgcccgcgccggccgcgcgcggatcagccattttagcgagtgggactccgaggcgcggcggacgccgccaccagtgccgcggctgccgccggcccggccgcacaccccccgcgcaccgccaccgccgccgcccccggccccgcgcgtcccccggggatgacagcggcggatttcaggggcactttctttcatcaggaggcttttgacaaaatggaaggtgaattacgggtgtcccggtgacccggcacgggggccgaggcgggctgcctgctgccggccgggactcccccgctcccggtcccgccccgcccgggccgccgctgcgggtctctgttgggcagcctcctgggcggctgctgccaaggggagctctttagttttacatgatgaccttgggtgtgggaaaaggaaaagatggcgggaagctggggggtgggacagggacgatgacatgccgcagctgcatttttatttggaaactttggagaaagtgttctcggctggacctgcattctgggttacagatgagcacgactagccctttttatacaccctccccctttagatagtgacgaagtgatgaattgaactaatagtacgggggtacctgctcactttccagatctcccgtgttgtaaagccgtttttttagtaagccaaaacacatcaacaatagtgacaatttcagatgtcccctacgtatagttctcctgctttggtcttgtgttcagcagtggtaagagttgttgtttttaattgtgttaacagttagcagatgaccagatagtcttaagtcatagatttcaagcttctatcacccccaccaaatgtgtcctctctctacccttcccactttgtgattgtagtttccaaaacatagcagttctgtaaacgtaacactgagtaccctacttgggtcggctccatttggagcacttgatcgcttttgagaagtaactcgcaaaccagcgcgcttcgtgctggtcaaaagttaaatgacaagcgacaatgaagctgatttctttcctactctgccttctgccactggtgtccggcattgggggaaggggacttcctaacagcaagtgtagttttagttttgctctgcctttggtacgtcttgtacttcttgtcaattcctccttgcttttcctcattgtatttctttgtttctcttttatcacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaaggtatttttctttggtacccttcaaactagtcttagttgggtttcttactttggggttacttaccttcagattttctcccagatagctgcttgcttcctcttttacttttacttagaatcatttttgcttgtcttaagaattttgtgtgtgtgcttttatttttttaaggccctgcacaggtttcaggcctttacctacccccttttgcaagtggttctagcaactgctagtttaatcacaagaaactgaataggtatgtgttcactgcatcgagggatttaacgagtcctgttctttgcagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtaagtgactataggattcaagataacaattaataccttttc

SEQ ID NO: 1126 - DNA, 3007 bp, Homo sapiens
aaagatgcaaatgacaatcttttatcaacctgagagcattcattgaagtcaaatcaggcattctgggaaatctaggtttccttgtaacacaatttgcaaaccactgctctgagggaaagtaaggggacagcaggaagcagcctgtttttattgtttgaggatagcttcctaaagcattccaatttgagaaataggacgtggttatttgagggagttccagggggtatcgaggctctgatgtgggatgggcagtgccagcagatggctttctgctcagacagtccagacattggtatgagggccaacctccaagacaggttctgaaacaaacaagaagggagagagaagcagtcccatcttttccccagaaacactcacaactattctacttttccttttttacacagtttatatgtaaacccagcacaaggccctctctcaaacagacctacatatccctacaaagacatgccaaacttcacacaggtgtgaaagtatgtgtttgctcagccaagaccagccactgaccttgtgaattgcttgtttctacactattcctaaaacaaaagtcatatttacctacacagatcttgccaaatgagtgcagttttctttttttttctttttttttttttttttaattgatcattcttgggtgtttctcgcagagggggatttggcagggtcacaggacaatagtggagggaaggtcagcagataaacaaatgaacaaaggtctctggttttcctaggcagaggaccctgcggccttccgcagtgtttgtgtccctggctacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatctacaggatcccaaggcagaagaatttttcttagtacagaacaaaatgaaaagtctcccatgtctacctctttctacacagacatggcaaccatccgatttctcaatcttttccccacctttcccccctttctattccacaaaaccgccattgtcatcatggcccgttctcaatgagctgttgggtacacctcccagacagggtggtggccgggcagaggggctcctcacttcccagtaggggcggccgggcagaggcgcccctcacctcctggacggggcggctggccgggcggggggctgacccccccacctccctcccggacggggcggctgccgggcagagacgctcctcacttcccagacggggtggctgctgggcggaggggctcctcacttctcagaccgggcggctgccgggcggaggggctcctcacttctcagacggggcggccgggcagagacgctcctcacatcctggacggggcggcagggcagaggtgctccccacatctcagacgatgggtggccgggcagagacgctcctcacttcccagatgggatggcggccgggaagaggcgctcctcacttcccagacggggtggcggccgggcagaggctgcaatctcggcactttgggaggccaaggcaggctgctgggaggtggaggttgtagcgagccgagatcacgccactatgagtgcagttttcaactaaaacagaaatctttagatcttgggggaagtttttatctgtaagtctagattcctgtttttccacttgcattttttattcctcttccccactctgcttctatcaacagcaacctttgttagcctaaatctctggctccctttatggtccagcagttgggcagggtttgaatggcaaggtggttctagaaaaacttctcatagaagtgttttgatcaactctgtgtaagctgatttttatccagagtgctgttataaaagcattaggttgggagtctgaattcttggaatctattttccttctgccactgatttctcaatgtgccccattgactgagaagtgagttttttcttttttctttctttttttttttttttgagatggagtttccctcttgttgcccaggctggagtgcaatggcgcaatcttggctcactgcaatctctgcctccccagttcaagtgattctcctgcctcagcctcccgagtaactaggattacaggtgcctgccactatgcttgcctaaatttttgtatttttagtagagacggggtttcaccatctcggccagcctggtcttgaactcctgacctcagttgatccacccgccttggcctcccaaagtgttgggattacaggcgtgagccactgcacctggccagtgagtttttactatgaggaacatggtcaacttgttgacaacctcaccggcttggggtacaaagagagtcatatttctttgagacttgactcttccagaatacagggtcagtgagagactgggaaattgcagggagactctgatgatagcctatgatagactgtatgcagggagtgacagaaggtccatgcatttacaaatatattctgagtacctgccagttgccaaggactagcttggtgctagggttagagctggtgcctgacctccagcttatgttgaaaaggaaatgtggttatataaacacctaagtgcagtaactctccatggtgttgggataggagagctgggtgtagaatgcagtggaggtgggccgggtgtggcggctcacgcctgtaatcccagcactttgggaggccgaggtgggtggatcacctgaggtcaggagttcaagaccagcctggccaatatggtaaaaccccaactctactagaaatacaaaaattagctgggtgtggtggcgcacgcctgtaatcccagctacttgggaggctgaggcagaagaatcacttgaacctgggaggtggaggctgcagtgaaccaagatcatgccactgcattccaatctgggtgacagaataatactgtctcaaaaaaaaaaaaagaatgtagtggaggca

SEQ ID NO: 1127 - DNA, 1193 bp, Homo sapiens
cagtctcagacactaatttctgttctgtctcacatctttcatatcttccctctcagtttccagccttgcctcctccacttatccgtgctggcctggtccctgccacctcctttggcactctctttgccatatagtgaatctcttattcccagcttggcattctcacccattgtcactttacctccatagcactgaccttggtagcaagtacaaattgcagtgatttcaataaccttaaggttatgataccatcagtcttgcaaatgcatggtattgttcaatgaagtctatagggagttatagaaataaagccatggataaggagaattatggtgtgctagtggaagcagtatccagttatcagtaggtgctaaagcagcattagtttttatttatatttatttagcatctttaacacccaggttaccaaaaagaacattctgtctcatgaggactttgtaaaaggagtgaaaatggatataaatgagaggggcaatgagttacttatgtattgattgaataattatttatgaatggtgactatattctgaggctgaagattactgagaggaaatgttttcatgccggctttcatggagtctatgatcagttgggagcagtatcaacaaacaataataactctttgcatccagaagcgctatcagcactggaaaaggcacgcatataatcttgttataataaaaaaatcccagagattgggcaacagattcctcagaacaggactcagagatggtgaccatgggctggagcagaagcatccatgatttattatttgtaccacactcactgaaagcctgtaagtccacatcccattaagcatgtttacttacaaatcccatccatgtgccactgcatttatatagtgtacattataaagtataactaaaatcgatattaaaggataacatttttaaaataagtaaaagcagaagttctaacatcatctgcctgagccccagtgatcacccttggcacctcctgagccgcactcctactttgataccatcagtctaatccagagtggagtcctccctgttgcttctgaagaatctggatttaataagctcatccagagatttgagataactcacaattgacaactccaagggcatcatgtgataatccagatgtttccaggatagtgggaaaaaccatttgtacaaggcatgact

SEQ ID NO: 1128 - DNA, 1851 bp, Homo sapiens
aagaaataaatatacgtctcctataaggcagtgtgtccactaaaaaactcttccgaaggccaaagaatattcagaatgagtttccaactgttccagagatagtggtgacaatgattcagaaagttttgtaaaacctggaagacccaagacaggcataaaaatacctgaaggatcaacatgggaagtggtaaaaataccatttgacatagcaatcccattactgggtatatatccaaaggaatataaatcattctatttcaaagatacatgcgtgtgtatgttcattgcagcactattcacaatgtcaaagacatggaatcaacccaaatgcccatcaatgatagactggataaagaaaatgtggtacatatataccattgaatactatgcagccataaaaaggaatgagatcatgtcctttgcagggacatggttggagttggaacctgttatcatcagcaaactaacgcaggaacagaaaaccagacaccacatgttctcacttataagtgggagctgaatgaacacagggacacaatggggggaacaacatacactggggcctgtttggggggtgtggtgaatgagagcatcaagaagaatagctaatggatgctgggctcaatacttaagtgatgggttgatctgtgcagcaaaccaccatggcacaagtttacctatgtaacaaatctgcacatcctgcaacatgtaccccggaacttaaaataaaagttgaagaaaaatagtcaaacaaagaaacaagtgcatttgaggctgtctcagaaggactaatccctggtacccgttgtgattttctgtgacctcacaccagccatgtttctaagaaaaagtcgtttcccgctgtcgggattcccctctgaaatgctcacccaatatctgctccaattaggtgattaattcagaacatatcagatcaccaccaataatagtttctggatgtgctgttagagaacaatagtgttggtcagcaatctcagcacagatgtactaattccccaggtgggtgtggaagcagtaaaacttttactcaactgtagttatcaatttctctctctctcactcacagaaaaatgttcatgagaagaaaagaaagctgacacagttcgtcaaaatgaaaataatgagactcactattgttgtttattcagatttgattttggagagttagaagagtttctatctcaagataggaattggtgttagcaagtgactgccttcagaatgtgttagaacctggggatctggcatgactctattttcctaagtttttcataaggcttatactatctaagaataactaaagaagaaggctgctagggagaccaaccaggaggctagcatattggtttggggtcagagctctaaccgatggctgaaagctataggaagactgatttgggctgccctggaacttggctttaccatcaatgatacatgaaaagtatctcagaataggcgggatacccactcactgaggccagagactggggagttaagtaccacacagcatcctattaaaatactctttaggggacatttaaatcctgaaattttacaacttattgagaaagcaaaaattattggtggagagaaagttgattgttttttgaatgttgaatgaatgaatgttgaatgaatgaaaaaattgaatgtcttgcttcccttttaatattgcaataaggtgtacattagaagcattttaaggggcatatatatataagaatatggatatattattggacatgacaacttatttagcatgatttatctgtttctgagaatgagactagtctatatgtatttcaataactcctaaattttctccattta

SEQ ID NO: 1129 - DNA, 1453 bp, Homo sapiens
actattgttgtaaagtaaccatatgcacgttacgaagacatatatagacgagggggaaaggcacactcttcttccaaggaagattatgagctctatgatctttacccagatatacaagggtaaattgaggctctcactcctctggcctcttcatcttttatttctcggggggttttttgtttgttctttttttctgagacggagtctcactctgtcacccaggctggagtgtagtggcactacagccttgacctcctgggctcaagcaatcctcccacctcagcctcccagtggggactgttgtagggattaaatgaaataatgcatataaaacagctgaacacagtacccggcagacactagtgctcactaaatgcgaactatattttttactgaagtctctctttaaaagtccatccagaggccaggcgtgatggctcatgcctgtaatcccagcactttgggaggccaaggcaggcggatcacctgaagtcaggagttcaagaccagcctgccaacatggtgaaaccccatctgtactaaaaatacaaaaagtagctgggcatggtggcatgcgcctgtaattccagctactcgggaggctgaggcaggagaacagcttgaacctgggaggtggaggttgcagtgagctgagatcgcaccactgcactccagcctgggtgacagagtaagactcccgtctcaaaaaaaaaagttcatccagaacaaacacttcaccatatacttcttatatcttacacatacttcttatgtgtgtcaactacaaatatctaagcatttttgtgacaaactcaaacagttaaaaaagagcataagtaatctctaagcctataggtaagtgatttttttaatgccttaaggacatgttccttcccaatataaaaacactcaatattccactaaagacaaaataatgtttttgaaatctaaagaaatgatcaagtcacataagagttacttaagttattctagagaaatgtggccagttttcagcaaacagaagaagaaaaaacaagaaataatgccatactacaatggcaatggaagtctcattcacaggttctagatcatcccaggtaacatgttctaaacatgaatacctttccttcctagttacctctgccttcaaaacaagcttgtgtcctgtctcccaagtaaaattcctaaacacaggaactaggtctcaggcatatgcaacatggacgaaatgagatcccaaacaagttccatatattcaggatggcgactgtggaaactgaacagaaaacaaacaaaaacaaagaggcagccttaccaataatggcattgtttcctccaagttccaacagacttctcccttaaaagaaaaaaattatatataaaaattaatgcctacttccatatttactgcacactgctacacagcctaatcccaattattaaattatatagc

SEQ ID NO: 1130 - DNA, 1217 bp, Homo sapiens
ggacagttacttattaaaactgaggtgagcattctgattcgaatctggtttcagtgtttttatttaattttcttgagttgattctttcatctttactccctcatactatatgtcttgtttttttttaattccctggctcatttaaagttttcctttttatctcttgttttgatcaacttgattgggacatgcttcagtgtagctattttcatttttcttgtgcttaagctttattgagattcttggatctatgaatttaaaggtttcaccaaatcaaacatttcttagcctttaaaaaaagtccctgttccctcttttactctaggcattccaattaagtgcatagtgactggagtgcctgacggagatgattttcagtgaaagactttgagagccttattaggcacaccaaccagtcatccatttgaataaagtatattgggaggtatagatggagatctgaatctcatgaaagagtttcacactttttgctatttcctgaaagtgtcttatcatttctaaaatcatgctcttctttatgttatttcatgaatctgaaatgatctatatcaccccttcctttaccccatgtcgaaatgtaaatgataattataggacaatttcaaattttatttcttttaaaagatttgtgtaatctccccagttaaatgtgacctcttccaactctgcatttggcttatgcctcttttgagcacttttactttacctagtgttgtaagcactggtgaacttttctgtctactaggtgatcattaccttgagagcaagacaatgtgttacagtttttacgccccttatggtactggttctaactatagtgttttgatagattgacagcattaaactcattgattataatttatttattaaataattcatcaaaaaattaattactaaatattgcgaatggattgccttattttaaaaaatgaatttaaaaagtcatttaactctgttataatattcttgtatatatattatttataatttctgaaatgcaagataagggatagagctgcagtggtcactgaggaatgttaatttatcttcagtttgttatgtctatggtgcagcgttcaatgcaattcaattttatttcccatatgttggctacggaaaaggaacaatatcattgctttactggagctaatgggagataatttatatgttgatatgagtaactacttttaaattta

SEQ ID NO: 1131 - DNA, 1426 bp, Homo sapiens
tcaccctaattcacaagttttttaaatctccagatctctaaacttctccagaaattgcttaaattttggagagcaggcaattctgatctaataatcttgcaactaaaaacggatacagtgattcatcccatgccatcgacaatacacagaagtgaaacatattgtgaactctattttacaatgactaactgaacatataattcatcatttatcgtgactaacagtaccatttagatattgagagtaccaatcctacaaggaggaaagaaaacatgagaacttcttagagtgtgatatttgctatgctatccaaaataacatcatggtgttaatttgtttataaattatgacattaaatttctctcaacttatatattcaatgatgttccaaaacttctatattcaaagatgttttaaatgtttgaatatataagttgaaaaaaaaataactccatactggaacattccctaatgtttgaagcaacatttgttagcagatatccacatatgtaaaacatatgttaaaaatgatactggtgaataccatcatgactcaagataatcaccagattaaaacattttttatatttagccaaattatagtgatacttaatttactaatacaacagggttttccttctactcttggtataaggtaatgtttcatgctcccaaagatttgctatctttatccacctcattagcctactctacgaggttatgatatttggctgtaggcaaatattagaggcctcagggagaggacagttttctttgggtcaatatttctgcctgctaccataacagaactagtttccctctactcctctgagaataatctaccttgttatttgctaaattcacaagctcgtgaaaaaggagctgttctagatgaattctaagtttagcaacatgttcagacactaaaatgaccatttttattatatggtagaaaaacacgtttttttcaattgctagcttagcagcactggctctgtatttaattgcaaatgagagagaaaacagtaactgattctggccgtggcttctttgcagttattgggtggctgaggtttagggcattcctagaggccagacctgacacaacgtgagattacattgaacttgccaatcacttcattagtgcaaaacaggcttcaacaaagtctcgtatttatttttaaaagcctaacagaggaaaatgatttcttaaattgttgtgctgtttctaatatcatcatttgataatatgattagtagctgacaacacaataggagaaattatttttaggtcatatgttgaagtatttgcatcataaacagaaatacccagaaactatcagatgcttagttttcaaactgattgaaaaaaaaaaaatgctctccatttaggaactagtgtccaattccaacccaatcacacaaa

SEQ ID NO: 1132 - DNA, 4534 bp, Homo sapiens
acatattttgaggaaagtgatggctattttatctaagaaagaatcccctggatcagatcctagattcttagaaattcaagaaagcaaaacaaaaaaaattaaacaaaggaaaaaacatctcttaaggttgacttttcaaagtattatttctatttttcaaagttaaattgtaatgaattcaatatttcttcattttttaagtgccaatttaactagaggaaaaatactaaaccaactagttatctttaattatcagaatacactatgaacagtggctttcatttaatggtatttttttgcccctgaggcaaattctatagagaataaagttaatatattgtgaattatttaataggaaggttaatttatatttaatacaaataatttaatccagtcctgcaagcttctatttatttggaatattaacaaacattgtcgaacactcgccatgcatctttcctgagctgtgggttgactgtacggccacatgcagaaaggacatatgctgcatgtttcagcacctgagacagacttggggccaccaaaaacagagcaacaatgtcttttaccgaccacaacacagctacacatgaagacccctgtgattctaatcctggacccatttcctactggttttatcacatgaaaccctttacttaaactgtttcagtttcagtatcttcctggaaaataagagtgtcctagtggtgctttaaaggcgaatttagcttcattatgcatcagtgtaaagtgttgcataattggcaccctgtgtcttacagctgtcgttatacttatacgaaaatttattacaaacgtaatgaaaattttttgaccaggtagagggtatcacagtggtgtttgagctgcttttaagtgaacattgctgtgctaagcactggaggtaaagaacgaaggaagactctatgcctgccctggaggcgtggacagtccagtgaggaaggtggcgtggatgaatggtctgcattcagtgttgtggatctcaggggagtggcactcatcctgcacgacgatctgcatatagctccctgagctgcctatggaactgagtgggcatcaaggggacaaggagcagaggaagggcatttggaatagtgggaccagcagatgcaagggcaaagggatgccaaacagtgccatttgcaaatgttagaatgatgattttggtgggaagccccgagtgatgcttgagtagatgagtacaaagaacccagcagggcacaatcacttagatgtttgcacactgagctcagtgttctacaggcttactggacattccacagagggccttggagcagaagaacaaagtgatcagatggaaattttagatcagcatgttcatcagaagcaagggtggaagggaggacacctcatcttcagaggatggataaaaggaagtgtggatggcagcaagggcaggtgaaactatgtttatgtgggcaggggttgcaggtaggaggtaaatagttctccctgacctcaatttgcctggaaggatagaagacacatttgattattaaaaataagacaatagccaggtacagttactcatgcctatagtcctaacacttttggaggtgaaggcgggaggattccttgagcccaggggtttgcgaccagcctgagcaacatagcaaaaacccgtatctaaaaccacaaaacaaataaacaaaaattcatctggatatgaaggctcagcctgtcatctagcactttgggaagctaaggcgggtggatcacttgaggtcaggagtttgagaccagcctgacaaacatggtgaaatcccatctctactaaaacaatacaaaattagctgggaatggtggcacatgcctgtaatcccagctacttcggagcctgaagcaggagaattgcttgaacctgggaagtggaggttgccgtgagccaagatcaaacatttgcactccagtataagcaacaaaatccatctcaaaaacaaacaaacaaacaaacaaaaattagctgagtgtggtggtgtgcacctgtagtctcagctactagggaggctaaggtgggaagactgcttgaacccaagaggtcaaggctgcagtgagccatgattgcgccactgcactccaggctgggcaacagagcaagaccctgtctcaattaaaaataataataatagagtagaaaacccatggatggtgttctggacaatctgtaagtcttccccactctaagtatcttcatctcctcccctccagctttgctctcccctagggtggttttgattttctaagcgtgtaaatgggctcagcaccctcactccaggtttcaaatcaaatctctgcccaagagggcatttgggagattgctgatcgccaatgcacaggctcagtagggccgacttactgctaacaaaaacttcaacaccaacaacaaaaagtcctcgtatctcaataaatgggaagaaaacataaaagatttaggcagacagaaagacaggtaatattccttacaaacattgccgtttcatctatttagttctaacaaattataaaatatcccccaaatctacaaacttcccattttcagatctcataggtctcacttacctatgtttcctccaagagagctccaataagtaacagaacgtgtctctcacagtttcaaaaaattattcccagccttgtgatctatcagaaagactggaaaccttcacatttacaagatactgaagaataagcttgatgctgaaattccagcgaccttcaggtagtgaaaaatccgtaattcccaagatggaaattaaggggaaatgaagctactactgttcagagaagtatgctcatgaagcttgtatgctccaagaataccaagaagctaaagaaagatttggctaaacaaaggaaacacagtgatacctatcatttagatagcatttcacggtttaacactgcttttgtatacaatatgccatttggtcttcacaataatcctgagagttattcgctacattttcacacatgtacaaacaaaggggttaagaagctcttacaaacctgtacagaacgagtaactgtactaagaaatggagttgtaacgattcctccactatattttcaccctaattcacaagttttttaaatctccagatctctaaacttctccagaaattgcttaaattttggagagcaggcaattctgatctaataatcttgcaactaaaaacggatacagtgattcatcccatgccatcgacaatacacagaagtgaaacatattgtgaactctattttacaatgactaactgaacatataattcatcatttatcgtgactaacagtaccatttagatattgagagtaccaatcctacaaggaggaaagaaaacatgagaacttcttagagtgtgatatttgctatgctatccaaaataacatcatggtgttaatttgtttataaattatgacattaaatttctctcaacttatatattcaatgatgttccaaaacttctatattcaaagatgttttaaatgtttgaatatataagttgaaaaaaaaataactccatactggaacattccctaatgtttgaagcaacatttgttagcagatatccacatatgtaaaacatatgttaaaaatgatactggtgaataccatcatgactcaagataatcaccagattaaaacattttttatatttagccaaattatagtgatacttaatttactaatacaacagggttttccttctactcttggtataaggtaatgtttcatgctcccaaagatttgctatctttatccacctcattagcctactctacgaggttatgatatttggctgtaggcaaatattagaggcctcagggagaggacagttttctttgggtcaatatttctgcctgctaccataacagaactagtttccctctactcctctgagaataatctaccttgttatttgctaaattcacaagctcgtgaaaaaggagctgttctagatgaattctaagtttagcaacatgttcagacactaaaatgaccatttttattatatggtagaaaaacacgtttttttcaattgctagcttagcagcactggctctgtatttaattgcaaatgagagagaaaacagtaactgattctggccgtggcttctttgcagttattgggtggctgaggtttagggcattcctagaggccagacctgacacaacgtgagattacattgaacttgccaatcacttcattagtgcaaaacaggcttcaacaaagtctcgtatttatttttaaaagcctaacagaggaaaatgatttcttaaattgttgtgctgtttctaatatcatcatttgataatatgattagtagctgacaacacaataggagaaattatttttaggtcatatgttgaagtatttgcatcataaacagaaatacccagaaactatcagatgcttagttttcaaactgattgaaaaaaaaaaaatgctctccatttaggaactagtgtccaattccaacccaatcacacaaa

SEQ ID NO: 1133 - DNA, 6350 bp, Homo sapiens
gagcagaagaacaaagtgatcagatggaaattttagatcagcatgttcatcagaagcaagggtggaagggaggacacctcatcttcagaggatggataaaaggaagtgtggatggcagcaagggcaggtgaaactatgtttatgtgggcaggggttgcaggtaggaggtaaatagttctccctgacctcaatttgcctggaaggatagaagacacatttgattattaaaaataagacaatagccaggtacagttactcatgcctatagtcctaacacttttggaggtgaaggcgggaggattccttgagcccaggggtttgcgaccagcctgagcaacatagcaaaaacccgtatctaaaaccacaaaacaaataaacaaaaattcatctggatatgaaggctcagcctgtcatctagcactttgggaagctaaggcgggtggatcacttgaggtcaggagtttgagaccagcctgacaaacatggtgaaatcccatctctactaaaacaatacaaaattagctgggaatggtggcacatgcctgtaatcccagctacttcggagcctgaagcaggagaattgcttgaacctgggaagtggaggttgccgtgagccaagatcaaacatttgcactccagtataagcaacaaaatccatctcaaaaacaaacaaacaaacaaacaaaaattagctgagtgtggtggtgtgcacctgtagtctcagctactagggaggctaaggtgggaagactgcttgaacccaagaggtcaaggctgcagtgagccatgattgcgccactgcactccaggctgggcaacagagcaagaccctgtctcaattaaaaataataataatagagtagaaaacccatggatggtgttctggacaatctgtaagtcttccccactctaagtatcttcatctcctcccctccagctttgctctcccctagggtggttttgattttctaagcgtgtaaatgggctcagcaccctcactccaggtttcaaatcaaatctctgcccaagagggcatttgggagattgctgatcgccaatgcacaggctcagtagggccgacttactgctaacaaaaacttcaacaccaacaacaaaaagtcctcgtatctcaataaatgggaagaaaacataaaagatttaggcagacagaaagacaggtaatattccttacaaacattgccgtttcatctatttagttctaacaaattataaaatatcccccaaatctacaaacttcccattttcagatctcataggtctcacttacctatgtttcctccaagagagctccaataagtaacagaacgtgtctctcacagtttcaaaaaattattcccagccttgtgatctatcagaaagactggaaaccttcacatttacaagatactgaagaataagcttgatgctgaaattccagcgaccttcaggtagtgaaaaatccgtaattcccaagatggaaattaaggggaaatgaagctactactgttcagagaagtatgctcatgaagcttgtatgctccaagaataccaagaagctaaagaaagatttggctaaacaaaggaaacacagtgatacctatcatttagatagcatttcacggtttaacactgcttttgtatacaatatgccatttggtcttcacaataatcctgagagttattcgctacattttcacacatgtacaaacaaaggggttaagaagctcttacaaacctgtacagaacgagtaactgtactaagaaatggagttgtaacgattcctccactatattttcaccctaattcacaagttttttaaatctccagatctctaaacttctccagaaattgcttaaattttggagagcaggcaattctgatctaataatcttgcaactaaaaacggatacagtgattcatcccatgccatcgacaatacacagaagtgaaacatattgtgaactctattttacaatgactaactgaacatataattcatcatttatcgtgactaacagtaccatttagatattgagagtaccaatcctacaaggaggaaagaaaacatgagaacttcttagagtgtgatatttgctatgctatccaaaataacatcatggtgttaatttgtttataaattatgacattaaatttctctcaacttatatattcaatgatgttccaaaacttctatattcaaagatgttttaaatgtttgaatatataagttgaaaaaaaaataactccatactggaacattccctaatgtttgaagcaacatttgttagcagatatccacatatgtaaaacatatgttaaaaatgatactggtgaataccatcatgactcaagataatcaccagattaaaacattttttatatttagccaaattatagtgatacttaatttactaatacaacagggttttccttctactcttggtataaggtaatgtttcatgctcccaaagatttgctatctttatccacctcattagcctactctacgaggttatgatatttggctgtaggcaaatattagaggcctcagggagaggacagttttctttgggtcaatatttctgcctgctaccataacagaactagtttccctctactcctctgagaataatctaccttgttatttgctaaattcacaagctcgtgaaaaaggagctgttctagatgaattctaagtttagcaacatgttcagacactaaaatgaccatttttattatatggtagaaaaacacgtttttttcaattgctagcttagcagcactggctctgtatttaattgcaaatgagagagaaaacagtaactgattctggccgtggcttctttgcagttattgggtggctgaggtttagggcattcctagaggccagacctgacacaacgtgagattacattgaacttgccaatcacttcattagtgcaaaacaggcttcaacaaagtctcgtatttatttttaaaagcctaacagaggaaaatgatttcttaaattgttgtgctgtttctaatatcatcatttgataatatgattagtagctgacaacacaataggagaaattatttttaggtcatatgttgaagtatttgcatcataaacagaaatacccagaaactatcagatgcttagttttcaaactgattgaaaaaaaaaaaatgctctccatttaggaactagtgtccaattccaacccaatcacacaaacaaaatgaacacaatgaagcaagtttagtgacatgatatcttcatctattaacttgggaaactatggaggattggaattagcatttctagagaaacaaatgcactagcaaatgtgagtgttcaaaacaggtaagtgctgagaatgtttccctgtccacagaacggtgtggtctaaaccctcttatagggttagcactatctttttccatttgtcctcaaagaaatttctccttcaggccacagctttgtagtattgctttttatttccagttcttcaaatctgattcatgggctgctgaaatataatgacgtcttatcccttttttttttttttttgctacagactaagttaattaggtggaacccaggctgaaagttcggatacctttggtaaatttgttttattacaggaggtgtttaatatatggctcatagttaaagctggttaaactaaagaagaagttgatattaagtttatatcaaatctatattgtatacttgtaaggcttagatatgacccacagttgtcaacccctttaactagttgtgatgcccatggcactctgagggtacacctgataccggaaggagagcattgactgtgagttctccaggttcttggcatttagaataattggataagatacacaaagtaacaaaggaaagaaacataggaaggaagctgtgaaaggggggatttattaaagccagaaagcacttcacagggtgggagggggcccaagcaagctgttccagggcctagttacacagttttctgggatttaagtacttattttgaggtccctctcagttaccccttatctggatgaagaatttggtccctggctaattaaaggctggggtgaattggcccgtgttgcagatgaagggatggccagtgcttggcccatagccaatccaaggcactctccctttccatctgagacacggtggaaggaggagggctatagagaaagcagcctttgatcctttgttgttaggaaatggggagacggaagtttttcctttccattaactttagaaagtttgagttaattgggcttaggttccctgcccccagacccagatgtttcccttctgatacagctttgggaagacagcacgaattggccttagacctcctgcccctagatcttgggcttcttccttgattcagcacaaactggccgtaagttccctgcctcaagaccttattctgcctcacactcaccccacttaaacaggataccccacttaaacatgtcctggccatattcattctacttctcttctttcttctgtaattttctgataagggtgtgtttttagaacttaatttatcttttctgttttgccaggaaaaatctgaagtgaagaatcacatttctctagtttcaactgctccatgagcatatcccattctgcaaatggatatccgcttgagggctccagtctaaatgcttcacctcattaccccttccctccagaatctggttagagtctcctaattgttatctggattgctcagctactgttaagtcataaaagaggtgaagacaagcttgttcttgtttgtctggagcttctttttatcaggagataatcagcaggacctctatgtcccgactgtgcggttttacatactcggcaaagagtggagatttcctcattgacctcttccaactttctagagacttctcagacataggagaacaggaatgatggatttaccaggttgtcagtaagagttgcatcaccaaaaagcaacattcgcaatcattcacaatgcagggaaccaggggaattgtgtccctgggagaagctgaaatagaactaaaaaataggctttcagactctatcagtgagtggagtgaagcagagaccccagaaatcatttctaacttgaaaacagaagggaggatagcatttgtttcataaaacgttctctactttatataaataataattatcttctacttttccgcttttaaaatatttttaaatgtttctaaaatacaaagatttaaggatgttaaaaatgtaacttggttaagaatataattacatggcgcagatataatagtttagacacatgtaataaaaggcacgaacccattcattcaattactaaaacactagtacgtgtttatattgagtacagatcctcttttccaaataggacattcatgacctggacaggtataactggaacttgtagagttagacttccaatgctttcttgttgagaactttatggtactcaccattttttgaggaaaaaaatgatccaatatgtcagaaagatctggaaaaatgtcccaaacattatatactatagtcttctttgggcaattgtgacttaatctgggaaaagtgacttaatctacaggttactatatattttttgtattgaaatatatacggtaaactagacggcatgtgagccctgtcaccctcaaacattgtcatcttgaatcccattcagaatttctttattattacattgttattattttttgtggagagacggtctcaccatgttgcatgggctagtgtcaaagtcctcggctcaagcgatcctgcccacttggcctctcaaagtgctgggattacagcctcacaacaccacacctggccacattccgcatttcttaatgaagaacatatatttgacttgtcccaaggaaccaaagtcaacactgattccctgcaggttctgcgtcagctcgcaccatgaagagtttttctgtatgaggaatgcaagggttggaatggcttccaggaagcagagccgttcacaccagctttgaatttgttgagttttcaaaatcatgtcttgctcaatgctcatcccttggcacatgattggccccattgtttgtaagactgaccacgctgtttcttgttaccgctgtcatttgtagacagggtgcaaattttgtaccctgcactaactaggtattcaaaaaaaatctgttggggagtgaacacttagcaacattgcagacacttgagggaggcaattgcatgtatctgcctcccacacaccaacataatggcagtcggtgaggaattcagagcctacatatgatgggtgacatataatccagcctcatactccgctggcca

SEQ ID NO: 1134 - DNA, 38815 bp, Homo sapiens
aaagttgaagagggttttcatcattctgacatacttcattctagaattatggcagcaaggataaaacagcattaatttgcacaaaattacaaaggtaatattacagtacatcacttattttctaattgtaacttagttccaaggctttgggggggacaaaaaaagcattcttttttcaatactccaagaaatttaaactattagaatgactctcagataccaactcatgaatcacacatcacactccctgattttatattaaatgattagtgaatttaaattttaataatgcttatgtatagatttactaaaatatttttaatcattaagaataattttaaatctataaactttattgtataactacatgttccttttaaaataaatttataaaatatatatcaatatcatagaaatataatattgtatcgtataggatatcagagatacttactacataatgtcgctaagttattttcctgacagacttgataagaatgacagtgactccaacaccgtgttaatgatagtctatttgctgacttttgtgagggaagtgcagttggtttgacttcgtacatttcttaagacctggttatttatagatttgctggtcataagacagctttgatgaccaaatattaagggatatttaacccaagaagaaataggatttactatatactcagtgccaacaatttgccaggctgtacaccaacatgatcccattaaatatgaacaacaaacctctgacgcagttagcaatagatccagggtggaaatgaagaaactaagagacacgtagattaagtaaactgtctaaaagagaaccagaaagtaccagccgcattttaaatacctgccagtcaccccgtgctttcccaatgtttggaggacatcgcatgccctacaaaattagggctcttctgcagagatggaggtgataagcctccaatcgccaaaccaaaccatgtgaggccaggaagggcagaccctcaggggctgcagctgggcatggctaaatgctgtaacccaggattttttcctagaagtaacactttctgtgaaaggggaagatttctggctcttatcaatggaagtcactgtcttccatcaaaaaaacaaatgatttaatctccccctccctctgtaacagagttcacagagaacagaaacttggtccacataaagaaaggcaactcctgaagaaactaatagctacgagaccctttaaggacacaaatccacgttaaattctaggctactgcaaagcagcactgtggctagacctacggtgataattggcaaagacgtgccactgagcttccagctttgacaaattacaatcagagactggaatttttctgtgtttaattattaaaagctttgatgctttcataatgccagtgagattggaaaacagaaaaatgatccatcagtacacaaaataggaagatgaagaatatttaggcagtccatgctgagatgttttttataactcggctacatgatggaagggttaggaattccttagagccaagttcacagttaatgacagaaacatgtagtaaatgatacaggctttgtagcttttagaatatattaggtcaacaaacattttccaggtcactatctggagcagatgcatgccaattagtaggctcagtgggagcctcacccatcccataacgtcctttattaattcttatctgggtgtgccacatatttcatttgctttactgtttcttaaatatatttggcctttaatgtttaaatatcattattgtgggtaaatcagtgcagttgaattgcttttagaagattcgggactgtgttttctttgatgattaacattgaaaatgtgaacttgtaacacatttaaagtgaggaaattcaacgttaatttctatggtttttatcacttttgaaaaaaagtcatttttcctttgatgataacattggaaatgggaactggtaacactcttaaagtgggaaaacctgatgataacttctatggttttatcacatttggaagaagtcacattgtagatcattagaattcaatgtgtttatgctgtgataatttactgatgatgaagtcagaagaacccaaaataaaatataatagagaactaagttcaagtgaggacctatagagaatgagaacacggaactttcaacgagatacacattccagggttgtatgtgattcctgaaatcagatttcacaatctcttacaaagaagtttcttatttgtcaattacaactcaaaaaagctggaaaaaagtttctgatgtacaggaaacaaagaataattaaaatattaatggattatctaacttttttttttctacattgcattccggaacgacattcccaacacacagacttctacgcacagaacaacgaagaaaaaaaagagaaagaaaaactattttctgcaagaagtcaagtgatgaatgttgtcctaaaacagtctgcggaggcgcaggggaggaagtgggggtgggcagtacgaccaggaggaagcttcagggctcctgggcaggggagtgtgaggcctgaggtcattaacagtaagcactgactggcaaattaataacatcaatttaaacagttataattccacaggatcctctatcaagctgattctaaatgagaaacttttctttacggatatgaaatgttttcttctccatatcaaaaaggagacaggggatttgtatttaatttttttccctttagtgtagaagggaggaaacccacgaagctgcagatggccactgtggacttctctccacggggtgaaatcaccaactgccccttgagtgtgtcttcaagtatcaaagccctgagaacttacagaagctttgtggccacctgcgcccggtagtggggaccatctggggtttcctgtgcctggcaccagcacgcacagccagacctcactggcaaggcccagtgtgaaagtgagggactaagtggctaatctggctggacttcctaggtcaatagggacttccctaagggggcttttccctaagccagaatgagtcacagctgcaaactaagggactgaaacttcaaccaatcatataggaagtttaagctctagttgcagcctgatgtttttaaccaatcaggcccaccaacccacaagcagatacaaaataaactaactctataggacagaaaaaggaaaagcggaggggttataaggagatataagcataagacacccaagccagaaacagcaactcttccgggtccccttccacctcttggaagttttactgtcgcttttgctttcctttcactttcataaatcttgccgccgcacactcttggggtccgcacgtttctctaattcagctgtaacactcgccgctgcagtccacggcttcattccttgaagccggtgagaccaggaacacttccatcgagaaaaaaacctttgatcaggagaagacttcttgtctcaaaaggaagataactcttggggccccaaaattactaaactaaagggaaaggtcgagctgggaactgcttagggccaacctgcctcccattctattcgaagtcacccctctgctcactgagataaatgcgaatctgactggcttctttggaaaagctaattagaaactctaaagagcgcaactgtttgtctctcacctacttgtgacctgcaggtcccctccctgctccagttgtcccacctttctggacgaaaccaatgcacatctttcatctgttgcttgatgtcccatgtctccctaaaatgaataaaaccaagctgcgccccggccgcactgggtacacgtcggccggacctcctgagactgtcaggggcgcgcagcctcaactttgttaaaaataaacattctaaattaactgagactgaaactgcctttgcagaattataactgaggaaattatgtcagtgacagaaatcagacctaaccaactctatgttgcttctaacctttaagttgtccttgttcattcctgggcataggctgaactaaatttgcgaaggaattcagttcacagtttgactctgaaacaaaattgtttacagcccttatcaactgatagagcccttatcaattgatcaattgataacagcccaagaagacccccatcttacctggtgtccagtctgctttgcaggactaacaaattagctacaagtttaggacttacggtttaggagacacgcagcctctggctccaagagtatgaaccttcccaaattgcttctggggatcacattactattgtaaaacctaagatctaagatcggtggttgtgatatgttgcagaccctgcactccatggatcagctgataccaccaagacttttaatctggcccgaccagttttgccattgcacccagaaacagaagacagcaagaaaaactcactttgaccccctgtgatttcatcttcaacctgaccagtcagcactacccacttcccaagcccccacccaccaaattaccattaaaaaccctgatccccaaatgctctgggagactgatttgagtaataataaaactccagtctcccacacgaccggctctgcatgaatcactctttcttcatagcaatgtccctgttgataaattggctctgtctgggcagggggcaaggtgaacccactgcatggttacgagacctgtctcagctattcagcattcacaccagaatggtgccaaacacccatcacaggacagcaccctagcgaagacacaaaccaacatagtaacatagatttcacttgcttaacctgtgcaccccacctccatgggcacactggaagcaggaggtctcccactgatggtcagtgctgcagggaggccactgatccacaattgtgggatggagactggggacgggccaccttctgctgtctttcatcaatttatactgcacatgtccttgaggctttctgtatttggttttcttctatctccttattagattctgagggtttattaatcattggttggttacttcactctcctggaagctgctcctctccgtttgaaaagccaacaaaaaaataaacatacaactcttttctcatagaaacaggcaacacttcattctggagatgtgtcctaacctggggtaggagatgtccaggacaagtaaagtggatgttggcaaagatcagtcccaggaccacagcatctgtctcctgggaatgggttagaacacaggctctcacgcccacacagactctgctggaagagaccctgcaggtgaggacctacactgtcaagctgatgctggtgcacattcgagtttgagagccactggcctacaaaatatatataccctggcctccaaaatcatagttcaagttttagccaaaaatcagtcaatctcctgtgattttttttaacaatcctagttatctgattcacccagagaaatgcttctctgatccatctttgcatctgctgcagaaacaaaggatatttaaagttcctgctatccctggaggtggctgtccggccccctccaggatcaaacccatggccttacggaaagcttctaacactacaggccccgctccaggttattctcatgcggctccctctgcttttcagatttcttattctagacttctttctttctggcagtacaagcctctcccttccttctttatccttcagcttcagccacctgaaaaaaaatctccaatctggaaaatctaaaccaaccaccttttctgaaaggacacagttttccaagcattaatgaaaaaaaaaaaaaaaaaaaaaaaaaagaaaatcataaaaactaacttcaactgcagacttctccctccaccagaaaccctttggttttcctagtcagttttccttcctttccacagagggattttctaattgtttctactttcccacaccacatacaacacccaaagtacctgtatgcatattagaaccactcaccccctttacttagactacttataaggaagatattaaataataggcagtcatgatgaataaatttaagaaaggtatattcagcatttactatgtgccagctaccaagtcttgacatatattgtctcatttaatctttactctgaagtagatggtatttgtactatcattatttatcattcttattattattgttactgttttgcagatgaagaaacccagacactgccagcaaatggtgaaggcagaattaaattcaggtactctgactccagagcatgcacagttaaacactattctgtcttgcaaagccttgtgatattggtaaatgccactgctttgggaaagggatgctgtcacttgagcaagtaccacattttatattcttcaggtgatttataacatctcaagagcagtggacaagacctcaaaatggttcctcaacagtcttcacatgcatctggcaaacactgtcaggccagcactcccacccccacctctggagaaaagtttgcactcttggtcggggacccctgcggaaaaagtgccctgagaaaacagcagctcctccttgaaaggcatgtttctgcatggctgacaggtgcaatcccgtggaggaatgcatgagtaagaatgatctgagaagactcgtgaattactacaaattagggtcagtttttaatgaggagacaagaacgtgaaccaagtaaaaacttatgtggatggtaaacagtaccttcgatttggaactaaaacatctgtgatgactctattgggaaagttgcaagacaactatgaatgcacatatgccattccacatgctctccaaggtttaaaatttaaaacaaccaaacaaacaaacacattgcttactcaaaccccctcctatattctatttttacagataacacatctcatctcttttagcttatctccaaaccttcaaagaccattgttacaaagcccatgcttgctttttcctcttgaagctttagctctccacatggaaatatgtcttctttctttcatcccataccccacaacctcacgcccacacactgtccactcatccttgctggatacttatactttcatcccacacaccacagcctcacacccacacaccatcaactcatccttgctggatacttatatcctagtgcaagtagggtaagtttcgggattcatgtcattattggtaagtgttacaggctctgtgcatgcgctgtatcatgaatatttctgtctcgtacaactcatattgttttaagaattcctgttttagccgggcatggtggcatgtgcctgtagtcccagctacttgggaagctgaggcaggagagttgcttgaacccgggagtcagaggctgcagtaagccgagatcgcgccactgcactccagcgtggttacagagtgagagtccaactcaaaaaaaaaaaaaaaaaacaaaacaaaaaaaacagaatttttattgttgttgttgcttttgtttcatctgtacttatcaccaacacatccccaacctcttcttccactttcaacatctacacttaatatgttcaaattcagcagattcctatcaatttcctcttctgaggatgtctcctggggagccttcagatctgctgtcaacaaaactagcacagtcattatcttctccctcttttcatgtggagcctgggaattcattttttgaaccttcttgaatgcattcccagtttccttgaccacctccacccccaacacaccatgttctcctttcttggctaatttcctcttttaggtagatgtactgagacaggtgcatgggagataaaaattgtgaagttttgtattgtgaaaaagtctaggagtaaatgacattttgccagggcataggaatccgattttgagattggattccatcagaatattttaggttatttactttacgttttttattattattattattactgacctactctgacttgtttcctctctggaaatttggtaggatattctcttttgtcccaatgttctgaaatcacctaatgacattttgttatacaagtccattttcattcagtattcagttttcttgggccctttcaatctggaaataaccatcctggaaaatttcttcaacaatttaattttctccatttgttactccaactttattttctaagttgtctctgacaccttttctttcctagatggttcctgctttttcatagcattctgttcttgttttgtgaatataatatatccttttacttctcaggtaattttaacaattatatatttaagttcttatatcttgcaaattttcagtttcttcccagttgctttaccctatgtgtttattgggaattttgcctttcttgtcagaagatttttatggcagtctgcttatattagaagaaaatgatcgaacctcctgagtgtgtgtgtgagaggagggctagggctgctccatcaccatggagtcactgtcagtaaatcaagcttgcttattttactgaaaaagacccaacatcttttccttagttctttctttctcttgagtggctcagggtccctcactttcttcttgtcagtctagtatgtaagtttggagagccaaggatgtctatattcatgcaaacgattagtttaacatctttattctggtataatccccaaatatgcctaaggtcttctattccaaagacccccagtaatggaagtggaatttgatcctaattccttgtaaaatatacttttgatcaacttttttactctgcctcaccgtcatcctcagtttagtgcaaaaatttctggttctgccaattgctgaagcttttgagtgtaccctgaggcgagttgatttgattcttggctttctgaagttttgcattaggattcttctttcctggttcttttaaatcaattaccactgaccttatgttttctaacttgcaaaattgtattacgctcttgtcttctaccatttaatttgtccttgtgaacttgtgactttgaagtaatcattttgtgattataatgtaattttagtggaattttggaggggagtagataacacatgaaagtattttgtctatcaactcaaaggaagattttgaggtggttaacatttttctttgtaacaaaatctgtcaatgcttacaaattatatatttgtatatataatattgtactatgtgctatattatatatatattatttaacttagaaagagtgttcatatgctgagataggtagaacaatgcattggatggacggattaattattcaggctttctgaatatcatatctaatctataaaatagaaaacattatactttggtcttaaaagtctctccctgctgttggaatctagcattaatgactccactggctcaagcgtgattggatttgtcctaatcctttttagaaatgcctcagagaagtgtgatttctaactgctgttaaaaggagaaccactgcttattcatttacaagttataatcataatgtagattttagacaaaagactgagagtagtacatcaaaagacttcatagttaaatagagacgccatttctataagtatacggcatgtggtgtggctgagtacagaaaggtaggagatgaactgtaggaactgaagaggctgaatctacacagagcttcctgtaatgtgaggtctgactgtgctttcatcttccacttggtgacacctacacgctcctcaaaataatattctaatcacatcccttaagccttccttgagctatttgtaccacctctctctcaactacccctgaggtcaaatatacgattaaacttcttaaaaaataaaagtttgaaaccaaatattttccccttggatattcactaaacattatgtttaatatcaacgcattttgtctttaactgtagaaaatatttttctcatatattgataaactgcatagtccctaatgcttagttttacacttgagaataggtacagcttcttgactagttctcaagtaaataaaacttaaaatgttagatagacttcatttattgcatcccttgcaaaaaatatactatcagaacaatgcagttgttatcaagattaaattagtatacaaatgtgacttttttttttttttttttttttttgagacggagtctcgctctgtcacccaggctggactgcagtggtgcgatcccggctcactgcaagctccatctcccaggttcacgccattctcctgccttagtctcccatgtagctgggactacaggtgcccgcaaccacacctggctacttttttggtattttttagtagagaccggctttcaccatgttagccaggatggtctcgatctcctgacctcgtgatccctgtgactatttctatcagaatcccttcttgatggcataacaaaggtaaaagcaaagcattatagattcttcaaaaacaggtaaagaatcacatatggatccccaaagtctgtcttgacagtaagaacgacatttctacagatcagctgttgcctgtttgtttatgcgggtaaaatttgtcatggatttttttttttttttttttttttcacggggtagtaatacccctttctaacatctagcactgctggattatgaaaattttatccaaggtgatgtttattctctgaaggtaaactcagactgagcaagacacaaaggagaatataaatgtccttttctgtatttcttgtagaatacatcttgactttgtgcctattctctagtatggtgtctgaaaatgatgtttacccatagaaactatttttatttaaaggaacaaaattccatttaacttttactttaacaggaacatgggtagtataatacattttattaggcattcccctgtttctgggtataattttaaaatgcaaagggggcaataaataaggccctttgtgctatagcatacatcatcaatggctgataattcattccagcacagtgtttggcattcattctaagccaaataaatattctatcttcacaactcatgacaaacctgatgagcctcgcaactcaatgtggggcttccacgcacttccgctgtcatgtgtgaatcaaaatgttgcagagatagtgttgatgttctctacaatccgtttaaaaagacacaaactgtgtgtgaatgtaaagaagaattgatataaatgcagatgatagacagtttgtagctcaagacaactaggatatatgaaatttattctatttctagaaagattatcttttattaacaaatcctgaagactatggtaaaagtcatttatttatttatttatttttgagatggagtctcgctctgttatccaggctgcagtgcagtggcgcgatctcggctcactgcaacctccgactcccgggttaaagcgattcttttctgcctcagcctcttgagtagttgggactacaggtgtacgccaccatgcccggataatttttctgtatttttagtagagaaggggtttcaccatattggccaggctggtctcaaactcctggccttgtgatctgcccacctcatcctcccaaagtgctgggattacagacatgagtcaccatgcccagctggtaaacatctaataatattattaagcaaagacttcaataaaactgatttgcttaaaagtctaagtttatactggaatgaggacaaataatgatagacttctcagcatggtaagcacttcacaaagcttaataaagtgacactttataacatatataccttcacacctctgtgacgtgttcctaacataaatttaaataaatgttatcatttaccttatttttctttcagccccaaatcagctagtatagaagaaaagcctgccctgcaattattcctcatattctacttttccttctcctcctcatggtataagggttttgtaggaaagccgtgcattaacgccgatatgtgtaataaacacatctttcatgctaagcattgtactagcaatgcgaagaggaaaactctaaaatctccatgtaagtgtagggaaaatatgtacaaacatttttacaccataatacataaagtgtaatctcaagactgtttatggttatggttttttttattattttatatccctgataatctgatttaaatatatcccttatctatagccatgccactctgaccatgcctgatctcctctgaaacacacacctgctttgcaatcagggttacacatataaagacaggaaattttttataagaaatcttgtaaacatagttatccagggaaacagaataaaatcttgatgttttctttttcaggtcatgcaaacaaacatttttaaacttcggttttcttatccataaaagaagagaaataatacttcagtatacatttttttaaacatttaaatgagattagctattaataaagattaattgctattattataagattatcaactcaacatcaatattgctggtataagaatatcaaattttcttttatgatttaatgacattgaaactcatgtgtatgtttgactatttaaaattaaagttgaaggaaagtcactgtccttacacgctgaattgtgtctccccagagttcgtatgctgatatattaaatgccattgccacaaaatgtgactgtatttgaggataaagcctttaggttggtgattaagctataaagacatctttaaggtgggtcctcatccatgacgatttttattcttatatgaagaaatcgggacacagaaaggcacaaagggatgacctttgaagacagagggagaagacaggtgtctacaagccaaagagaaagacctgaggagataccaaacctgctatcactttgatctccgacttccagcctccagaactgtgagaagataactcttgttgtttaagccacctagtctgtggcacattgttatggcagccctaaggaatgcatacaacttccaacaaacacacctacacacgtgctacctgattctctgattctacctttaaaatatatctagaatcattcaaattttccatccctaccgcctttgatttctgtgaaccacaccacttacctcttactacaagagtctcctcctgacattcatgtctccaatataccccttctgagccattctcaacacggcatcatgagtgatttattttaacacaaattttgtccttggccttggctgttgaaaatcgtttgatagcttccaattgctcctagaataaagttacacaaattgctcggaaggctttcaattatctagtttttgctaaactcttcatctcattcctcaaccaacacatctgttgtatactaggcaggctcagcttagtgtctgggttctcttctgcctctagaatttttattgattattttgtgagaggatagacccctttcttaaactcttagcacagtgagttcacatagaatgaaaaaaaattcttccataataaataattgcataaatgttcttgacgcacacaaaatattgtcatattctggtacaatcactataaaattttcattagacaggcttccatttatcacttcaggaccaacaatgttgagaattaagctgtcccatgggaatatatttattcatgtctaatgccttccttaacaaccattagaaggagggaaggaagacagaagaaaggaagaaaggagggaggagcgaaggaaggggaaagaaggaaggaagggaaaggagggaaggaaggggaaagtgggaaagagggggaaggaaggggaaagagggaaagagggggaaggaaggggaaggagggaaggacggaaattatcagaagcaaaatgaatataacttacacactaaatatccccacatataaaaccaaagctttaggaaagcctgagaaaaaacagttatgtttcagattggaaacaaatattaaataagaagaaatgagttttgattcttaaaatatcaagaggaaaatttagtttgcactgttaatagttcaaagatgtttgggataatatatgaagaagaaaccaaaatatttggatattttgcttattagtcaggatattattattgtaataatataattcagtcaccaatttatcatttaaagaattgctgtgtaaactagaaagagaaactgattaatgataggaataaaaatctagttaatatccatttttaaacaatgggatagatgtaactacaaattggcatttttttaaatctaataagaaaaatgttctgataaattgcaatgatttgggatgttttatttagcatatgttagttttccctggattgggctttctaaactattggtgttaagtcaaatactgtggaagtcctagtcattttcatcacaaattgaattcaatttcaaaaaatattatgggtaaaaaccaaagaagaattttaaatggcacttggcaagagaaaaaaaatgaactgactcagcaaaaggacttcctttgaaggaaactttccaaaggacctctcaaaaagaactgctataactatactgttttcttagaaaagatacgatatacacaaaagaacagctatgtgaacacaaaaattgatcacatatatagaaatgaactattgaaccagacttgacagattgtaacttgaacacagtcaggaacacacagggaccatctttttttagcttccagattttatcactatcttgatctgttagtgataataaaatattcatcgctgagcacaaatgaagctgcctgcctgcaacttgactggagggtcccttgaaataaataacataaaactggttctcagcaagcatcccttttgaaaaatgcctctgtgtgttagcaaaccaaagaactggatgctattatattactgtccactacagcaatagcaaacatgctcttcaatgactctcagcaaaagatgcaaaatgcctctaatttacagtatttcagaagatgccaattccagccagcaagagaggttgaatatatttccataaaaatagtgagacagcattttccttttttcctcttattgtctcacaagtgtgctgtgagtcttcagagactacgtaacatcttatgtagccatcaagccaacggctcttgaaaggtgtgcatgtgaattatttgacttttataatgattagtttgttggactcaataatttgtaagattgtgaagggatcctgacatccaaatgtttgacaaactctaggtttgctttgtgattatttacgaatttcagagaacagaaacttaacaaagaaaacagtcacagccactctttctcccaagtactagattaaaatatcatcaaaaccaatattcagcctatatcaatgaaacaaataaatgtgggcacagtgagaaaccaagcagctgtgtatttttacaacatgatcacagttggttggcttttcgggctctaacttcctttgctacttcccttagttgtctgcttattttgggagaattttcaaaatgtggaacagagaataagccattcataacagatgctgtaaataggttatccatttcctcctacctaatagcattagcctcatcttgcctggaaacagttgcctttaattaattctccatgatgcctcttttctggtagctatgagaaattgataaagaaacatggtctaattttaatcaaaataggacgtgtcagtggcactcaggctaaccttgcaggctaactcagacatgttgaatagagaatgcaaacttcttatgctaaatagattaatgaagaacagaaaacaaaagttatcgcttgtgtttaataatgaaattaaatatattgtcaaaatagagagtattttaaaaggtaattttcactacagaatataacattgtttttccttttaaaaatattatggtagtgtttaatattccatttgtattatgttttctttgatggttacaagatttgatgttaatggaactggttggtttgtaagatacaaaaaagacaactgttaattgatcacatttttataagcagtttcaatataaattcatactgaaagtaacttcttatatagctgtaagacaagagatcacatcgataaagatactgtatttcacgatgttgtattttatataaaattacactttcctaaatttctcaaggaaaatctaagccttataatccaaattaattttccccttacattatgtcagaaactcagttagtgttattttaccttttggatgccttacattattttttttaattaatttatttatttacttgagatgaagtctcgctctgtcgcccaggttggagtgcagtggcgcaatctcggctcactgcaacctccatctcctcggttcacgccattctcccgcctcagcctccagagtagctgcgactagaggcgcccgccaccatgcccggctaatttttttttttttttttttttttttttttttttttttttttttgtattttttagtagagacgcggtttcaccgtgttacccaggatggtctcaatctcctgacctcatgatcctcccacctgggcctcccaaagtgctgggattacaggcgcagccttacattttttttttttttttttttcaggtctctaactgatgggttttccttttctcctggctatgccataaactaaatggcaagatgcaggtttcagaatcatacacttcagagttgagatttacacatttgagttgtggcaaagctggggcaaggagtcagtgttctgatacctgctctggcactttgcctccttacgtccagttctgagctctcagcctcaaaaacaccttctatcaaaaaaacacagaacgcaggaggaaatgcctacaagtgccttcattccatccactaaaaatgtacaaaatctcaggagacatattttgaggaaagtgatggctattttatctaagaaagaatcccctggatcagatcctagattcttagaaattcaagaaagcaaaacaaaaaaaattaaacaaaggaaaaaacatctcttaaggttgacttttcaaagtattatttctatttttcaaagttaaattgtaatgaattcaatatttcttcattttttaagtgccaatttaactagaggaaaaatactaaaccaactagttatctttaattatcagaatacactatgaacagtggctttcatttaatggtatttttttgcccctgaggcaaattctatagagaataaagttaatatattgtgaattatttaataggaaggttaatttatatttaatacaaataatttaatccagtcctgcaagcttctatttatttggaatattaacaaacattgtcgaacactcgccatgcatctttcctgagctgtgggttgactgtacggccacatgcagaaaggacatatgctgcatgtttcagcacctgagacagacttggggccaccaaaaacagagcaacaatgtcttttaccgaccacaacacagctacacatgaagacccctgtgattctaatcctggacccatttcctactggttttatcacatgaaaccctttacttaaactgtttcagtttcagtatcttcctggaaaataagagtgtcctagtggtgctttaaaggcgaatttagcttcattatgcatcagtgtaaagtgttgcataattggcaccctgtgtcttacagctgtcgttatacttatacgaaaatttattacaaacgtaatgaaaattttttgaccaggtagagggtatcacagtggtgtttgagctgcttttaagtgaacattgctgtgctaagcactggaggtaaagaacgaaggaagactctatgcctgccctggaggcgtggacagtccagtgaggaaggtggcgtggatgaatggtctgcattcagtgttgtggatctcaggggagtggcactcatcctgcacgacgatctgcatatagctccctgagctgcctatggaactgagtgggcatcaaggggacaaggagcagaggaagggcatttggaatagtgggaccagcagatgcaagggcaaagggatgccaaacagtgccatttgcaaatgttagaatgatgattttggtgggaagccccgagtgatgcttgagtagatgagtacaaagaacccagcagggcacaatcacttagatgtttgcacactgagctcagtgttctacaggcttactggacattccacagagggccttggagcagaagaacaaagtgatcagatggaaattttagatcagcatgttcatcagaagcaagggtggaagggaggacacctcatcttcagaggatggataaaaggaagtgtggatggcagcaagggcaggtgaaactatgtttatgtgggcaggggttgcaggtaggaggtaaatagttctccctgacctcaatttgcctggaaggatagaagacacatttgattattaaaaataagacaatagccaggtacagttactcatgcctatagtcctaacacttttggaggtgaaggcgggaggattccttgagcccaggggtttgcgaccagcctgagcaacatagcaaaaacccgtatctaaaaccacaaaacaaataaacaaaaattcatctggatatgaaggctcagcctgtcatctagcactttgggaagctaaggcgggtggatcacttgaggtcaggagtttgagaccagcctgacaaacatggtgaaatcccatctctactaaaacaatacaaaattagctgggaatggtggcacatgcctgtaatcccagctacttcggagcctgaagcaggagaattgcttgaacctgggaagtggaggttgccgtgagccaagatcaaacatttgcactccagtataagcaacaaaatccatctcaaaaacaaacaaacaaacaaacaaaaattagctgagtgtggtggtgtgcacctgtagtctcagctactagggaggctaaggtgggaagactgcttgaacccaagaggtcaaggctgcagtgagccatgattgcgccactgcactccaggctgggcaacagagcaagaccctgtctcaattaaaaataataataatagagtagaaaacccatggatggtgttctggacaatctgtaagtcttccccactctaagtatcttcatctcctcccctccagctttgctctcccctagggtggttttgattttctaagcgtgtaaatgggctcagcaccctcactccaggtttcaaatcaaatctctgcccaagagggcatttgggagattgctgatcgccaatgcacaggctcagtagggccgacttactgctaacaaaaacttcaacaccaacaacaaaaagtcctcgtatctcaataaatgggaagaaaacataaaagatttaggcagacagaaagacaggtaatattccttacaaacattgccgtttcatctatttagttctaacaaattataaaatatcccccaaatctacaaacttcccattttcagatctcataggtctcacttacctatgtttcctccaagagagctccaataagtaacagaacgtgtctctcacagtttcaaaaaattattcccagccttgtgatctatcagaaagactggaaaccttcacatttacaagatactgaagaataagcttgatgctgaaattccagcgaccttcaggtagtgaaaaatccgtaattcccaagatggaaattaaggggaaatgaagctactactgttcagagaagtatgctcatgaagcttgtatgctccaagaataccaagaagctaaagaaagatttggctaaacaaaggaaacacagtgatacctatcatttagatagcatttcacggtttaacactgcttttgtatacaatatgccatttggtcttcacaataatcctgagagttattcgctacattttcacacatgtacaaacaaaggggttaagaagctcttacaaacctgtacagaacgagtaactgtactaagaaatggagttgtaacgattcctccactatattttcaccctaattcacaagttttttaaatctccagatctctaaacttctccagaaattgcttaaattttggagagcaggcaattctgatctaataatcttgcaactaaaaacggatacagtgattcatcccatgccatcgacaatacacagaagtgaaacatattgtgaactctattttacaatgactaactgaacatataattcatcatttatcgtgactaacagtaccatttagatattgagagtaccaatcctacaaggaggaaagaaaacatgagaacttcttagagtgtgatatttgctatgctatccaaaataacatcatggtgttaatttgtttataaattatgacattaaatttctctcaacttatatattcaatgatgttccaaaacttctatattcaaagatgttttaaatgtttgaatatataagttgaaaaaaaaataactccatactggaacattccctaatgtttgaagcaacatttgttagcagatatccacatatgtaaaacatatgttaaaaatgatactggtgaataccatcatgactcaagataatcaccagattaaaacattttttatatttagccaaattatagtgatacttaatttactaatacaacagggttttccttctactcttggtataaggtaatgtttcatgctcccaaagatttgctatctttatccacctcattagcctactctacgaggttatgatatttggctgtaggcaaatattagaggcctcagggagaggacagttttctttgggtcaatatttctgcctgctaccataacagaactagtttccctctactcctctgagaataatctaccttgttatttgctaaattcacaagctcgtgaaaaaggagctgttctagatgaattctaagtttagcaacatgttcagacactaaaatgaccatttttattatatggtagaaaaacacgtttttttcaattgctagcttagcagcactggctctgtatttaattgcaaatgagagagaaaacagtaactgattctggccgtggcttctttgcagttattgggtggctgaggtttagggcattcctagaggccagacctgacacaacgtgagattacattgaacttgccaatcacttcattagtgcaaaacaggcttcaacaaagtctcgtatttatttttaaaagcctaacagaggaaaatgatttcttaaattgttgtgctgtttctaatatcatcatttgataatatgattagtagctgacaacacaataggagaaattatttttaggtcatatgttgaagtatttgcatcataaacagaaatacccagaaactatcagatgcttagttttcaaactgattgaaaaaaaaaaaatgctctccatttaggaactagtgtccaattccaacccaatcacacaaacaaaatgaacacaatgaagcaagtttagtgacatgatatcttcatctattaacttgggaaactatggaggattggaattagcatttctagagaaacaaatgcactagcaaatgtgagtgttcaaaacaggtaagtgctgagaatgtttccctgtccacagaacggtgtggtctaaaccctcttatagggttagcactatctttttccatttgtcctcaaagaaatttctccttcaggccacagctttgtagtattgctttttatttccagttcttcaaatctgattcatgggctgctgaaatataatgacgtcttatcccttttttttttttttttgctacagactaagttaattaggtggaacccaggctgaaagttcggatacctttggtaaatttgttttattacaggaggtgtttaatatatggctcatagttaaagctggttaaactaaagaagaagttgatattaagtttatatcaaatctatattgtatacttgtaaggcttagatatgacccacagttgtcaacccctttaactagttgtgatgcccatggcactctgagggtacacctgataccggaaggagagcattgactgtgagttctccaggttcttggcatttagaataattggataagatacacaaagtaacaaaggaaagaaacataggaaggaagctgtgaaaggggggatttattaaagccagaaagcacttcacagggtgggagggggcccaagcaagctgttccagggcctagttacacagttttctgggatttaagtacttattttgaggtccctctcagttaccccttatctggatgaagaatttggtccctggctaattaaaggctggggtgaattggcccgtgttgcagatgaagggatggccagtgcttggcccatagccaatccaaggcactctccctttccatctgagacacggtggaaggaggagggctatagagaaagcagcctttgatcctttgttgttaggaaatggggagacggaagtttttcctttccattaactttagaaagtttgagttaattgggcttaggttccctgcccccagacccagatgtttcccttctgatacagctttgggaagacagcacgaattggccttagacctcctgcccctagatcttgggcttcttccttgattcagcacaaactggccgtaagttccctgcctcaagaccttattctgcctcacactcaccccacttaaacaggataccccacttaaacatgtcctggccatattcattctacttctcttctttcttctgtaattttctgataagggtgtgtttttagaacttaatttatcttttctgttttgccaggaaaaatctgaagtgaagaatcacatttctctagtttcaactgctccatgagcatatcccattctgcaaatggatatccgcttgagggctccagtctaaatgcttcacctcattaccccttccctccagaatctggttagagtctcctaattgttatctggattgctcagctactgttaagtcataaaagaggtgaagacaagcttgttcttgtttgtctggagcttctttttatcaggagataatcagcaggacctctatgtcccgactgtgcggttttacatactcggcaaagagtggagatttcctcattgacctcttccaactttctagagacttctcagacataggagaacaggaatgatggatttaccaggttgtcagtaagagttgcatcaccaaaaagcaacattcgcaatcattcacaatgcagggaaccaggggaattgtgtccctgggagaagctgaaatagaactaaaaaataggctttcagactctatcagtgagtggagtgaagcagagaccccagaaatcatttctaacttgaaaacagaagggaggatagcatttgtttcataaaacgttctctactttatataaataataattatcttctacttttccgcttttaaaatatttttaaatgtttctaaaatacaaagatttaaggatgttaaaaatgtaacttggttaagaatataattacatggcgcagatataatagtttagacacatgtaataaaaggcacgaacccattcattcaattactaaaacactagtacgtgtttatattgagtacagatcctcttttccaaataggacattcatgacctggacaggtataactggaacttgtagagttagacttccaatgctttcttgttgagaactttatggtactcaccattttttgaggaaaaaaatgatccaatatgtcagaaagatctggaaaaatgtcccaaacattatatactatagtcttctttgggcaattgtgacttaatctgggaaaagtgacttaatctacaggttactatatattttttgtattgaaatatatacggtaaactagacggcatgtgagccctgtcaccctcaaacattgtcatcttgaatcccattcagaatttctttattattacattgttattattttttgtggagagacggtctcaccatgttgcatgggctagtgtcaaagtcctcggctcaagcgatcctgcccacttggcctctcaaagtgctgggattacagcctcacaacaccacacctggccacattccgcatttcttaatgaagaacatatatttgacttgtcccaaggaaccaaagtcaacactgattccctgcaggttctgcgtcagctcgcaccatgaagagtttttctgtatgaggaatgcaagggttggaatggcttccaggaagcagagccgttcacaccagctttgaatttgttgagttttcaaaatcatgtcttgctcaatgctcatcccttggcacatgattggccccattgtttgtaagactgaccacgctgtttcttgttaccgctgtcatttgtagacagggtgcaaattttgtaccctgcactaactaggtattcaaaaaaaatctgttggggagtgaacacttagcaacattgcagacacttgagggaggcaattgcatgtatctgcctcccacacaccaacataatggcagtcggtgaggaattcagagcctacatatgatgggtgacatataatccagcctcatactccgctggccaagtcgattctcaaaaaaagggtgatatcgtttggaaacatgaacttggagaaaacctctcccaggaccctcatccactcgaggcagtaattcgcgtagtgcagtcggcacagtgccatagcctctgcttggtgtctgacacatccaaagcaggtggattcattctgataagcttcagcccaacatcgacttgcagagctggcaattcggggttgataatgtggcacagcagactccaaagacgtgtacccaggatgtgtctcagcagtaagtgtagagttaacaatgttgaaaaggctgtttacccagttcctcagacgttgtgatgtgcacagtgtgtgttctctggttaaaacaccacaactccagggaaggaagctccattattatctgtctaaatgtttatatggacacatttttttttttttttttttttttttttttttttttgagacagagtctcgatccgtcccccaggctggagcgcagtggtgtgatctggactcactgcaagctccacctcccgagttcacgccattctcctgcctcagcctccagaggagctgggactacaggcgcccggcaccagactcgactaattttttgtatttttagtagagacgagtttcaccgtgttaggcaggatagtctcgatctcctgacctcgtgatccgcccgcctcagcctcccaaagtgccggcgtgattacatgtgtgagccaccgcaccggccagacacactgaactttaaggaagtcaactcacctcaccggcatcaggcatcttcatcaggtaagagctccgccagcacttcctgtccatccactcagaggccaggagagtcagagatcgggggttttctgggcttttccttcaccctcctgccctaactccagctgtcctcactccaatgactgtttagaaccatcccctcctgaccaatctcttcctcagttaccctcacatgattcttcttctactctccccccctgcccccaccaccaggcaacactccctcacacaactactgaaaaagaaagcacgcatgatttgactgctgcctacctcgaatccttcagcggctcctcctcacctgcgtaattccatacaaagttcccagcggggaaggggaagccttctgtatgctcacctgtctattgcgccccacccttcttccctcagtcctcagtggctgtgctctcctccacactgccttccccacatgctgccctgtctagaatggcttttccacctaccttctggaaagtcccacgcctcatttcaataccctacatgattgcctttgtgctcccaccacaatctgttcctgtctccattagagccctcctccttaggcattttaattagtcatgtataaacctgtttctggataatgataatgaccctaataaataatatcggttccctaatgcagctggacatgtggcatgtagtgcatgaaggttactctgagtgctggctcatgggaaccccattctttgaaatatctgacatcaccatggtcaggtttcagatgcagacactgaagctcacctaggttaacaacccccggcaagccatggacttgccatgtgagatcagagcctgacccaatgtgccgactccaaagccgggcaggaagacacatcatcagaaagacttctctggtctggaaatggtagctgagcttcatggaatcaggggctgcatgtgattcttctcaaagcctcggaggctcctgcagcacaaactctggggtgcaccaggtagaaacccacagaagatgcaccaaagccctgagtagaggttaggtcttaaaaccacgggttccatgattgtttcccatagtctgttctatgacctttacggtaaagaaatatacaagcaggaggaagacttttctcttgaaaaacataacacagatggcatctttgatgcgcgtgacatgctctgggtgaagctcaacttagagtcaataacagctcctgcctaagtcagctgggaccactataactaactgtaagttataagttgctatagactgggcaactttaaaacaaaatgaaaaactcagcaaactatcacaaggacaaaaaaccaaacaccacatgttctcactcataggtgggaattgaacaatgagaacacatagacagaggaagggaaacatcacacaccggtgcctgttgtggggtggggggagggcggaggaatagcattaggagatatacctaatgttaaatgatgagttaattcctgcagcacaccaacatggcacatgtatacatatgtaacgaacctgcacattgtgcacatgtaccctaaaacttaaagtataattaaaaaaaaaaacgcattggctacttggagttctggaggctgagacattcaagctctaggagaccagctgtctggtctggtgagagccttgtgtgtagacagtagctgctcctggaatcctcaccttgtggatggcagagagaggagcgtgccctcgtgtctcttctagtaagggcactcagcccacagcgagggctccactctcatcacctccttgcctcctaaaggctccacatcctaatgccatcaccctgagtttagaatttcaacaggtgcattgggaagggatgtcatgattcagtccctcatgctgcctttggcttgtgtcctgggaaagatggcacatggtcgagagacacagcctgcattccattcccaacatagttcaccatcatctgcacttttcagactacctaacttcacctgtaattaaacatttcatattaacttttttttttttttgagatggagtttcactcttgttgcccaggctggagtgcagtggcacaatctttgctcactgcaacctccacctcccaggttcaagcgattctcctgcctcagcctcccaagtagctgggattacaggcgtgtaccaccacacccagctaatttttctatttttagtagagacagggttttcccatgttggctaggctggtctcgaactcctgacctcaggtgatccgtccacctcggcctcccaaactgctgagataacaggcataagccactatgcccagcccgtaattttcatattcctaaaaaaagtaaagataagctttcacatattcactgagaatttttaaaacatcactccagtttgcatttctaaaaagatacactttggtataataaaaccaatatatcttaggtggtaactgccatagctctgagcaatatttgaacggtatttctacataagggccaataaaaggaaatcttccaatatatttgaaggattactctatctggaatcttgactgtaaatactcagggaactaccatttcaatactaaccaaaaatatttaattctaagtacagatcaaaatccgaaccagatttatgctaaaagggaaataaacaactggtccttctgtctgtagaatcatcctagctcaacacctacagaatggaggatgctaagtgctacactgaaggaataaacaatgctgagtgatgctgagctccaacagaaacattttccaaataacctcaactccaagcatccagccaggccttgctggatgtgtcgtagttgcttcagggaaggtcacttgagaatttcctattaaaataccactttaattggttcattctctttataaattaaatgcataatgattatttgtaagctgacccaggtccactctaatgttcagtaatctacctcttggtgttttgttaaattgtgaacaacaggaaattctgtgatgtggtacacaaagttcagcactgtcacagagaagtcagagagactgatggatgcctttaaaatatcctcaacgctgcacgtaaaaggcacgtgttgctgtgggtgaagaagttaatgtaagtaaaatgaactcgtttgttttttaagggagtgtattttccacattgtgtattttaaggaataaactgtgatatcttgaggatagacaaaatccaggtatgtcctgaggcatctgtcttgtagtcacaggatcggccccaggaaaacagggccatttttccatcatgcacctccctccagcctgcattccctttccccagatgtagaagtctccaagcttcctcagctccctgttaggaaggacatctctaaattctctaacccgtgccattctaactcagtgtctgcagctgtcttttgtgcctggctacctttggaagtaatgtggactctcttatctttggatggcaggcttttgacaacttcagtgccttttaccggggcttagaacttcagctaacagaatttttcacaacagagatatcttctagaaggcagaatttctctttctgttcttccaagtgtaatgaattaacatgaccctgctgaaggattcataactcaggtacaggtaaaacaagcaaacaaaccaaacaacaagcattaactgcaattccaatattcttccagttttccaaatggttagggtgcagataaggagtgtttagcatttggtttagaaccttagggtgtggaaagcagattcagaatgcagattaaaaaggaatttcaaaaaccaacctgctttatctaaaaagatcatttaaatgtgtagtttgcgcacttgcagaggtgttgggagaagacagggagggacagaataaccttaacaatatggattataaatataaaaaaatgtcctgctgagaaacgcctgagaaagagcaatgttttgttccctctcctgtgctttaattacagtctgcaacgtccaaactttcagtaaaagtcttccagatacaggactagacattattttggagaaatgatgcaagagaaattgtgtcccatatgcagacgtaataaaacggttgaggagcctacagctaagtttacgggtggtgccagggtgcaacttgcatccttctcccagcagaagatattaggatccctgttcaccaaatacattagaagagccaatctttgaaagcaaaggaattcaggcaaaatcctttctgttaccataacctcttcttgtaatatcaagtataaatacggtgaagtttacttggaaagctaaaatattcagactactttagaccatgcatgtgtaaatcatttgccttgttatagatcctaagatcaatgcttcaagagataaatcacttatttacagtgagacattaactacaattcagtttctagatcctgctgaccaagaaaaatactctttaaaaatataaataaattctgagacatttgtaattgcaataagatattgaatcacccatatctagtttaacaaacacattatacagaagtgaaccaaatggaagattttggtagtgaaactttatcatagacttataccataacattaaattaacatggggaattaaaatgttatccttgtcagatatgtttctcatggattgtgacatgtagtttcactttgttatcaagaatctgtggcatcattattattatgtcaacattataggtgaaaaaaatccaactgatttcctcaagctcacacagataaattaacagcgggtaaatactagaggaagactgtagctttttcctagtgccacatttcttctgcaaatgcttattttatatgaaaaataattgttcgaagtttttttatatatatagcatgaatcaattatatttccatgtaccttttctattgcaggcacacattaaatattagagggcagagaagtccatttgtctatcagcagagataagttttgcctgcataaaatcaatgggaggtgtaagcagttacaatccttcctgcttgtggtttgctagggggtcattttaacgtaatcaatgtgtttagctcgataccttcatttgactatgctttaatttttttccctttattaagaactttcccaaagtccagatttatatgggtaatatacaggaaattgtatagaaaaatatcaacgataattgtttgaaattggataatttataaaactgtagctaacatagttcttacatctttggagaagaaggaacaccatacactttcaacattattcccactttctcaagagaatgctctatgatggtaatatagaaatacgatggttaaaaatctacttccagttataaatcagctttttgaattgaatatttacagaaatcaggtagacacgtaagcaggaatgcttatgtactaatgtttttaaaatcccttacttaggccaggcacagtggctcacacctgtaatcccagcaatttggccaaggcaagtggcttgcttgagcccagcagtttgggccaaggagtatggaaaacactgcaaagccctgtctctacagagagtaccaaaaaaaaaaaaaaaattagctagtcatggtggtgcacacttgtgttcccaactccttgggaggcttaagtgggaagatcgtttgagcctaggaggtcaaggctgcaatgagtcacgattgtgccagcgcaccgcaacccaagcaacagagcgagaccttgtctcaaaaaagaaaaaaaaaatcctttacatatacacacacacaatagatatatacgtccatagtaatatatacatataatcaaatatatatgcatgcatttttatgggaatatacacacatacacgtatagtgagagagtagggaatgtatgtatgtgcatgtgtatttatggagaaatgagaaattaacatcaaattagacttaagatttttctcaaaaactttatgaaaggtgtatactctatcctcttctcaaaatcttagaaatggtatttgccttcatttttctgctatgacaaggtgaacaaatctcgtagcaagtgcataccatttattacaattgtaaaatgacttgtaacgtgttattaacagtttttgaagggggtatgattctttttcagatgtgtaattaatgtagccgtaaaggaaaatggcaatgttgtattgaatactgaatcttgactgtggtgaccatgccaggaataagataagcagagcccagttcctgctttgccgctaactcagcaactcacccaaggggagctggagagtatgccagaaatgatacatacggctataaagacagagtgtccaagtttgactcagttcatctccgggctcttctcacttccgacattgccccgttttgtgaacttgactgtgtctctttctacattctggaagcaacagtgtaatactctgcagttctaggttccctagcctcattcatgctgttgcctgtgccccgcacttagcagatgagccagtggataaggttctgcagctctgcttcccagtctttctgacatttctgctcacaattgttgaattacaaagcaccagctggtccctcgtcagcagcggcctccacgcaatcatgggaaatgctgcattccgtcacagggtgccctgagatgtccctgctctgtttcctctcttcaccttgcaaggcagctgacatcctttattttctcataacgtcactgcctggaatttccgcttccatcaatccggcagtcccacagatataagaacccatgcagtgggcacggtttcagtgtggtgaccctgtgctctaaaaccctttgtcaggggaaacacagtttttatgtatttgtgtctgaaacaaaaaatgacggaacgtcacatgcaagtggtgaccgtagctatgtggctttcctgactcatggcagcaaactaacatctcagattccatcatctaacccagccaacgaggcactgtggatcctgctttcaagtgttttctgcattactgacagcaaattactgagaaggcagaatccaatgatagctttccatcctcattttgcaccgtattttcagcttgctgccacatttgttttcctaaggaggtaataaataaattggaagaaacactgaaaatacagcaaagagtcaggagtctggcttcacaatctgcgacagctgagggtgagatatacaattttacacctatgataggagatctataaccttagatgccacatctattcaggaagaataatatcaaggttagtgtaagcatacaatgaaataaagtttctggcaaacagtaatgctaaaaaataaataaataaataagatgtttctgttctcagcttcctatttaagttgaaaggatgtagtccaggagtattcagtcaagcaaatgtccatgttttgtgacatatatctctaatctattgtataagtatagacaaaggcatttagcagatgccactttattgcctcaaagagctgaaaatcaatgggtatctgtggaaggagaatggtttaccccaagttcaaaactgtgtgcagacaagagccactgtggagaaagagcagaagccaggacactatgcttctaacgccgtgagctgggccaagaggtgaggtctttggcaataggaatgcatgagcctacaaaaggcctaagtaaaaagttttaaaaaaggaattgtattctagtcccttagttgataacctgagaattctcattaaaaacgtacaaggaaaaagagatcatgtttgtagacctaccttatgcaagtaaggctaatatccccgtaagatatgaatatcactgatcacagagaaaataagagaaagactgaatgttggaaagagaggcacgattataaattagtgaaagctttctgatttgttgataccaagtcagctgcatcacagtccacaaatatttgttgaagtgatacatttttctaaattccaagtctattgacaataatacaaaatgttatattgaaaattaagtgggctaccctaatgctactccagaaacacgactgcaagtttctgcagtgataaacctcatcacagaacctaacactgctgcagaatttgtcctgttccaggcccgatttgtgctttgaactcatgcaatgcctacagtggccacatgacgcgcatgcactattgttcccatgctacagatgagataaaagaggcactgactgtttacataatttgcccaggattgtccttttgcagtttgtaacagagccagatgactgggtcacgcaaatgttgaaaaggggcagcagagaggtgaataagtccgggtgtgaattagggggtggagcagcaagatcagcgtttgggtctcgcattagagtctcacctgcatgactcccgcagggtaaacagccacgctgcttctaatgctctgctgtagatcacattccttttactttataaatcagaacttgcctctgtttggcaggaaccttgtttgggaaatgaaaatatggtaagtatgtgtttccttctagttaaacaagggaaagtatcgttcttaaacgccaaacttaaatggttaaaaaagttaagtcttaggccatgtcttagaacgaacgttcttatctttaaattgtgagtcattttttcagatagagacaaggtttgattttttatcactcttggttagctgatgacataatacacattcaaagaaacgtgacagattttaagcaaatttctaatcaacagtgttctacttcgtcaaatcacaacagaaacattcctccgtgtcagcttttgtcattgatccccggatctttccagtaatttgtgtattaagagccacaaaggggaatacacaaagctgcaaagtcaattaaatcctcttaaataaggcaaaatgaaacaacaaaaaagtgccatcctatagccctctctgttcccagtaagtgcgggaatgagcttttgaggaatgcacagcccaggtgttctgcagctgcacattttaatcatcaagtcaccaaagtctgctgataaacatcaaaaaagcctaatggagtcacagacccagtggcctggttcctcagatgagctccatagattcctacagaaatggaattggaatagggctggctggagttatcagagcataataatcatccgatcctgacattaagagtccctctgcctcacaccacccagaggcaattcgttgtgtgaggggtgtgggaacaaggtttcatatctggactgggatcactgtgatatccttggggtggtagcaaaatctttctttttactaactttttaattatggctaaagagttgatggggttgaaaatgctttctccttttcaatgaaggctctgaacggccgtgcaaagtttatgttctctctggttttgataaaacttaaatgaatgcagaagccaatggcaagtccataaaatttctcaatgagtctctgtactgacttgagaaagaaaggataaatatgctattggtgctaactcttttattgagcatttttatgtccaattctttatcttccttatgtgtaataaagtaagttcctcttatttgacttactaaattcaaattctaaaagatcacttctatccacatacccaaaagcattcagttagtgacaatattaaaaacaatgggaaacagtagtttttgctatttggtgataccaggtacccatctgcttgtgatttaagataattttctgtactgtcaggggcccaagaagagactatgtgcagtttgcagtggggccagtgacagcttcaacctttgaacaggaaatccagacagtacagacttttgggaagggcccaaattacagatcccagcagcgagcagcaagtactatgaacacaatcacagggaggctttttaatttatctgagcttaagtctcctcatacataaaatggagtgcatttttcttacctctccggacatttgtgagggttacgaaactttatctatccaaccaactttgcaactgcttggcagatgatgcatacatcccagatgatattaagtaggggtggtggccaggcattgaggggcatgttatgcacacaaggagcctgtagaccagaacagggatggacccgccatggccagggtgacaaatctcactgcctatcttgtggaaaccctaagagtgtattttatatttttaagtggtagaagaaacatcagaagaagattttgggacaagtgacgatgtatgaaatttacatttcagtgtccacagaaggagtttataagaacacaacagggcccgtttgtctacatcctgtctgtgactagtttagtgatgcaattgcagagctgggtcactgcaccagcaactcagggtgggcagagcccaagatatttaccatcattttctttgaagaaaatgtttattcacgccagctcaaaggttgaattgaaaattttctattttcgtcctttttctttctctattttcccctacctccttccctccctccttcacttccttccttccttccttctgactagcggagaaagaggctcaaagaactggttaaagcagctctagctacctctagtcaatgactgtgttgtcattcccccgtattgctaagaccctctgccggtcatgtaacaaatgcaaatctttcacgcagagttgattttcagaacagctcagacctctgttatctgggcatggggtgagggcatcccctcacgcccaaccggccttgggtgggtctgcacagttgtccctctggccgtccttttcctaggagtcagggccagggctgacctgcctggtccagcgttcacagctgggtgaacttgcccagggccttggtccagctttagtcagtctcctatcctccccacaggaaaacaggatgctgaagttgggcttggtcctatcctccccacaggacaacaggatgctgaacttgggcttgtccctgaggttaagcaagctgtaaggttcagaacatcttttagcaacgtatgccgagattggccaactgttgctaggaccctttcctgctcaactgcccccatacacggaaccaatgcctgctcaaagctcctgctacccctacccctgcttccccattacaatacaagaaaacccttttttttttttttctgtttgagcttaagatccctgcagtccctgaggtcagaccattctccctacggccttcatcatttttagtgaagtctctcctttcctaagcccagacatacttattttggcaccattgatgctaggacggaggatcatgcccccatgccagctctgcagacatcgggaagactaaacaacagaagtacatgtcaagcccttggaggaaggatgcaatcatctctactgcaaaaatacattgcaaagaaaacccgaaagaaatagtaatatgaatacagccactagtgcggtcatcactattgcaaaaggatattgcaaacaaacaaacaaaaaaaaatcaaagaaacagtaatactaatacagccgctagtgcagtcatcagtatggcaaaaggatattggaaaaactcccaaagaaacagtaatattaacacagccgctaggttgtgtcctaggttcactatgacagaacagtcctcgttcccctccttcttatttttctggcccagaaatgataattttcacagtggcgttgctggtggtagtggaagatcaacgccgtaataatgagtattatgggccagcagctattcctaaaccaccccattcagtccttatcacaaccccatgagaaccaccatcatcgtcacttgatgggtgtgaacactgaagtgttgggattttagaactttcccaagtttatcatatgggatgatgtagaatccaataataggaagtcagttttcagaatctgaaatctcaagtcctcagtttactactgtttccagctgaaaagaaagattatctttctataattattatttgttttttgagacagtttcactcttgttgcccaggttggagtgcagtggcacaatctcagctcaccacaaccttcacctcccagattcaagcgattctcctgcctcagcctccatagtaactgggattacaggcttgcaccaccaggcccagctaatttttgtatttttagtagagacgaggcttctccatagttggcaggctggtcttgaactcccaacttcaggtaatccacctgtctcggcctcccaaagtgctgggattacaggcatgagccaccgtgcccagcccgtaattctttattgatagataaccgtgaaatgttttactcattggggtagcatttagtgtaagtttaatttatacctcaagtattttaaaagctaaattaatgtccattattagtactcaaatggaggaaatatttttatttgtgattcagtaatcccactatgtgatatctaccgaggggaaaagaagtcattatatgaaaaaggtatttgcacatgaatgtttatggcagcacaattcactactgtaaaaatgtatccatcaatcaacgagtggataaagaaactgtggtatatatatgatggaataccactcagccataaaaagcaatgaattaatggtattcacagcaacctggatgggattgcagaccattattattattattgtgagacagagtctcactctgtcgcccaggctggagcacagtggcgcgatctcggctcactgcaagctccccctcccgggttcacgccattctcctgcctcagcctcccgagcagctgggactacaggtgcccgccaccacgcccggctaattttttatatttttagtagagatggggtttcaccgtgttagccaggatagggagaccattattctaagtgaagtaactctggaatggaaaactaaagaccgtatgttctcacccataagtgcgagctagcctatgaggatgcaaaggcttaagaatgatataaaaaactttcgggccttgaggggaaagggtgggagggggtgagggataaaagactaccaattgggttcaatgtataatgctctggtgatgggtgcaccaaaatttcagaaatcaccaaagaactttcatgtaaccaaataccacctgttctccaaaagtatggaatttaaaaaaaaaaagaaaaagcactgaggacattaaaaaataacgtcttaattccaagtattaactttgaaaattatgatttactgactaagacttaaggggaagtatttgtcttttatatagcaaaaatctggctaattgttctttctaaagtctaactttatcataaagtaacacaaaacattctgattcttggaaagtactgaatttaggaaactctccagcaacaagcataaaaataaaataatgattgaaaaccattttttgtaaagtaatgaagccaactttggaaatttggtgttatgttgacatatatatacgcaactttaaattcaatgaaatagtccagaataaagaatatatttcaataaagtaagtgttggtcatgtgtcttcatgaggtccgaacatc

SEQ ID NO: 1135 - DNA, 1088 bp, Homo sapiens
acgaaattttaaacacagatgaagcggaaaaagaaagaagactttacccatgcatccaatgccaccccccacccccccgcccccccggtcaatgataaggaaacgaaattcatcacaaaccgaaaggctcaccattcgcgaagctctggaacaaggagagagccagtatccacatgcccctgccgctccccggcctcccgcgagcgacgcgccggcctcgccccccgcgctccgcccggcccggctccgctcgccgctcggcacctgcccgggggccgccgcccgcccgccgcccgccgccgccgccgccgctgcctagccgcccgggcacgcggcgcggccgggctccggagcgagggctgcgctcgccgcgcgctgcgctcctgcacacctgctcccgggcgccgcgccccacgctgcggccggagcccaggtgcgccgtcagctcagtgggcccccggcaggtcggcaggtggagagagccgcagacgcgggcgtgagctcatcccgggcactcggcgcccagaatgcgcagccagcggcctcccgtgcgccagccctcaccctccgcatccaggcagcaggcgggcgggcaggctcatctttgccgtgctccggcctcagtcacatggatccctctgccaaccttccctgcctgcgagccgggcgagtgaagccgagcgcggaggcgagcagggacccctcccctgcctctggccgctggggcgctctgcagtcttaaagcagcagcagagacgtgcagccgaactgaggcaggaccggggagagcgcagccaccgcacagtcacgcacagtcatcaggaggaatttcttagaggcttaaataatcatttcaacagctgcttatttttagttattttcctgccggttgctaataagggatggccggggtgactattgcggaaggtggccagccacggagaggtgaacatgaaatgctcgtagttttaataaaatgtgcagctggattccgattccgtatttactctcagaaaagtccagttcatttgcttagagggaaatgctccttccaaatccttgctgctactgtaaagatctctatgatt

SEQ ID NO: 1136 - DNA, 2294 bp, Homo sapiens
accttctttcaactctaccttttcttagtcaccgtttttttaaaaaattgacaatgctcatgcatttcttctggcctgttggtatgctgattctttaggcactgtctaggtaggcaaagaaaatgcactgccttgcagccaacacacagagcttccctgtgtgtcttccaggaaaatcttagagcctcccctttgcttctcgtattttctcacaagggccagatttcctctcttctcttcttttaccttctcttcttctcctctctctctctctctctctctctctctctgtctctgtgtctgtctcgctctctctccctcctctctttctctctctctctctcctctcttctggctaggggattctgcttaatggtttaatttcaactgtcagtaggttatacattttatgcagatgtgtgttccaaaatttgaaatgggaatttaagccgtagctactcccaggcgatgtcaaatgatgacaatttcctctggttcccacaagagaggaagccattcatacatgtaagttcatatttatgcggtgacaggcagcctaaggtgcagtcacacttactaattgggtctgactcagtcaagagcaatagctttctaaatacccaggaagaaatcatttcaaaatataatattggctgggcatgaggaaatgtatgctatttacaatattcactgatttcatttttacaactatacaggtgtttttttttttttaatttgtcaacatttcagatgatgtaatgcttatcagtgcatatttttacataaacgactgtgaggagcatgaagcagcacggggtgcatagaaggacagaacattcttaaagccctccttggtgctggagatacattgtactagcatgaaattacgtgtttgaaaaatctcaaaaagcattgaatctgaagggagatgttcctcattgacccctccacttgcgtgcacttggaatgtcacatccctttccaggttgtaatattcaaagtggcaatcttcctgtctctccttctgtcaccaaacctggtttattctgaatgaggcagctctctagtactggagttaggctctgagctgtcacttggctaggtaagcgccttccaatgattacagagcaatttctcccgggcctctccattgccacctcttctcccccaaaaaataaatatgatatttaaaaaataaataaaagcacgaaattttaaacacagatgaagcggaaaaagaaagaagactttacccatgcatccaatgccaccccccacccccccgcccccccggtcaatgataaggaaacgaaattcatcacaaaccgaaaggctcaccattcgcgaagctctggaacaaggagagagccagtatccacatgcccctgccgctccccggcctcccgcgagcgacgcgccggcctcgccccccgcgctccgcccggcccggctccgctcgccgctcggcacctgcccgggggccgccgcccgcccgccgcccgccgccgccgccgccgctgcctagccgcccgggcacgcggcgcggccgggctccggagcgagggctgcgctcgccgcgcgctgcgctcctgcacacctgctcccgggcgccgcgccccacgctgcggccggagcccaggtgcgccgtcagctcagtgggcccccggcaggtcggcaggtggagagagccgcagacgcgggcgtgagctcatcccgggcactcggcgcccagaatgcgcagccagcggcctcccgtgcgccagccctcaccctccgcatccaggcagcaggcgggcgggcaggctcatctttgccgtgctccggcctcagtcacatggatccctctgccaaccttccctgcctgcgagccgggcgagtgaagccgagcgcggaggcgagcagggacccctcccctgcctctggccgctggggcgctctgcagtcttaaagcagcagcagagacgtgcagccgaactgaggcaggaccggggagagcgcagccaccgcacagtcacgcacagtcatcaggaggaatttcttagaggcttaaataatcatttcaacagctgcttatttttagttattttcctgccggttgctaataagggatggccggggtgactattgcggaaggtggccagccacggagaggtgaacatgaaatgctcgtagttttaataaaatgtgcagctggattccgattccgtatttactctcagaaaagtccagttcatttgcttagagggaaatgctccttccaaatccttgctgctactgtaaagatctctatgatt

SEQ ID NO: 1137 - DNA, 2046 bp, Homo sapiens
gcagcagtgaatatttagaggattgtatgattgttcttccttatcagtctttgaatgggcttatggaaaataagacaacttctggattgtttataatttaatgtgaattatttgactgagttttctacttagggtttcatctaacatggatttttttgtaaaacccatgggattggctgtttttcctcattctagggtcaccaggactttttcagtatcatgtctgtcacaaacctttcaagtacaattggatcttcatgattttaaggcccaagaggcacagcagctcacaccacagcatgtacctgctgcaaaactatctcctgctctgggccttactcaaacttcatagctctagcaaatacaccagtaaatccgttacaaaatattgttcacataagccaaataagcctatcaagtgcagtacttctttgttgttgaggatgtacaaattaatggaactctctttccctttggagggaatagctattctggccgtagaccattgttctcctagaaactttattcaggtggcaatttactattttggggtgtgtgagaattatctcctatcctctagtactcatgtgtcttatcaaggcatctcatgaattagctaatttctgcttaccaggtctgattaatatgatttcattgatttagtagggcagtgtaatgacaagatgggcaaggtctgcaagatagattatgacagagttaaagaaaagatatagtttcacatagcgctgagagaaaatgtatactactatctctgcacactgaaaacaaaaaactggttttttgactagtttgataatttgcatagagaaaacatatttgtcagactaagagctgcacaccagattctagggtcttctatactatgggatttaaatttgcagtaagtccctgtcattttccaagacttatctgtcttcttaaataggcaatttaacagggatgtaagaggaatcaacaactctgtgtctttgaagtctttgatgatggcactaatctctgtaatgccccagtgatatagtaattgcttttggtttactatctttggggaggagaaaattacagggtctttaacttggcccttcgtattcttatagtattaactctatggtgctgtgaaccaaagtggggtttcttctaattgctgagtatggatattccaacttatattaatatttagtcactaaaggaagaaaagagcatagcatgtttgcagacctactgggtctactgtgagacagactcaggctaatgttctattattatctgacctccgtaagtctccgctataacttgtggcccagaattaacttgggaacctgcacattaacaatgaccacaaatcctggaagacctggttatttttccccccagataattatcactttaataattagctgcagtttcctttattaaaacatctatggaaatatttgaggcagtgatatatgatgctttctcaagtagatccagcttcccatttattaaagagattttatgtctatgaactggttcaggtctaaaaattgggtgagagactatagttttccattgtagtgacttgagacagatgtccaatctttattcctaaagtataactttagtggaaagtacacctacttcaattcttgagtcaatggcattttgtaataatctctgtgtgtcagacgttcttactaccttattcaacctacctcccattagaataagcacacccatctttgtctggcagttaagtgtctgtctgtccaggattccataatagctattgtaatcaaggaacctctttcaatgacaccatctccagctattatgtatctactgatttcagaatataaccatacccaaggatgctggcatttcactgaccaatgcatttcccagtgctttggtaaaatagaaagttctctgggccctcctagtgatacaatgaagaggtagattccctcctcaatattataacaaaagtgttcaagaatataattttatttaatgtagattaatgttgaatttaatgaaccaagaaaa

SEQ ID NO: 1138 - DNA, 1132 bp, Homo sapiens
aacagagaagtaacgataggaaggatgaaaaacaaatcatacaaagcataaaactggggccagggggcttctgtgcagcacagaattgctaaaagaaacagatgcttcccaacaattaaaagttgagtattccttatccaaaatgcttgggaccagaaatgtttcaggttttggattttttttttttttttttttttttttttttttcagatttggggatatttgcatatacataatgagatatcttggggatgggacccaagtcaaaattcatttgtgtttcatatacatcttatacagatagcacaaatattttacacaatattttaaataattttgtgcatggaaaagtttttgtacattataccagatgtggaattttccacttgtggcatcatgttggccctcaataaagtttcaaattttggagtgttttggatttttggattagagatccaaaaaaagcagtccccaacttatttctatatccagttaaagaaaccatattttaatgagagaacaatttgcccaataacctaacccccaattgttccttatttcataagtcacagtatgctttagggcaaatattcttaacttttccttaaagatggataataagtttctgcctgtataatcctatgtaactatataagcaatgctgcaatatactagttatgggaaggtagtgtgatgtgatgtaacaacagaagttaacacttgctcagcacttcttatgtgccagactgttgaaagagctttactaattcatttatttcaaccatcctacaggttaggagtggttattatctacattttaacagatgagaaaatgttaagtaacttgcccaaggtcacaaaattagcggagccaggatttaaacctaggcatagaaagagcatgagctttggattcatacctggtgttcaaatgtcaactgtgtgatatgtactacggtaattaagcttttagaatctagtttcctcatttgtaaaatggagatgaaattactgggagaattaaatgcattactgtatgcagtcatgcacttagcagtgcctggaatactgcaagtacttaataagatatatgctagttagcaataaatttaaaattaaagtttataaattc

SEQ ID NO: 1139 - DNA, 10608 bp, Homo sapiens
ggttcattaatgtgctggtctttctatttttcttgttatacttagtcacttaaaaacccttttttttttttttttggaattcttatttttacagtactttgaattcctgttttattaatcaccttcttatctgaaagtgaagtaatagtgtacttggcaccattgaattagaaaattgtgtgtccttggccagaagatcacatacacaggaactcgataagttgagagatttagccgtttcagaaatgggcatttgtgtcttccagtggagaagcatctgcaaaagaattgggcagatttggccaggcgcggtagctcatgcctgtaatcccagcactttgggaggccgaggtgggcagatcacctgaggtcaggagtttgagaccagcctggccaacatggtgaaaccccgtctctactaaaaatacaaaattagccaggcgtggtggctaacccatttaaagtgggtgaattatatcttttatgttttaatgtattcctagagttgtgcaaccatcaccagaataagttgtagaacattttcatcaacccaaaaagaaactttgtattcattagtcgttcctcctcatttctcccctaacctcccagcactaggcaaccatcagaatactttttgtctccacggatttgactgttttggacatttcatattaatggaatgcacaatacagtagtataatacattaattttggaaggccaaaattaatggcttttgatgtctgccttttttcacttagaataatgtcttccaggtccatctgtgttatagcatgtatcattactttatcctttatgtggctgggtaatattccattgtatggttataccatgttttgtttatctattcatcagttgatggacatttaggttgttttccattgactattaagagtaatgctgccggccgggcgcggtggctcacgcctgtaatcccagcactttgggaggctgaggcgggtggatacgagggtcaggagatcgagaccatcctggctaacacggtgaaaccccgtctctactaaaaaacaaaaaattagccgggcgtggtggcgggcgcctatagtcccagctacgcaggaggctgaggcaggagaatggcgtaaacccgggaggcggagctggcagtgagccgagatggcgccactgcactccagcctgggcgacagagcgagactccatctcaaaaagaaaaaaaaaagagaataatgctgccatcatgcttgagggtttttttttattttgttttgttttgtttgtggggggagcggagggcacagtctcactctgttacgcaggctggagtgtagtaggcttactgcagcctcctccgccccctggttctagtgattcttgtgcctcaggctcctgagtatcatgctgcaatttttgtgtgagcatacatttttcatttctcttgggtcaatatctaggagtatccccacttttggttctgagtgttaattgagcctgttgtgttctcacattccctgtacttagatggaaatagtgctttgcctaaaaagaaaataaaagacctgattgtgcaggcgagtgagaaagagagagaggcgctagggttatttccaccctgatactctttgggtagtcttggtatgactagcaaagaagcaagctccaagttgtagtttgcttccaagtttctggcttctgtgggaatttctgcatctaagtaatgacaattttcagttacttgcagtaagtaaattatcaaccaatcttactgtgtattactagcctagtaggaatttacttgtatatcgagaggaatgctgcagctttcaccttacttctaatggggattaatgcttacttaacttgcagttttggaggcaagtacaaagtacaggaccaattatggtcatgaagtgagagagaagtctggctagtgaatggtgattggcaactccagttgactgttcatggcatcttagatctgtgaggagggaggagggaaggaaagttcaagctggtctttatggtaagttctggaacatttccctgtgtcaatgggtcatctgttcattcactgtgtaaaatggttgagggaagttttaatttacatgcttccttattgtgtaaacctttgatttttagtgatttcagagtttgtttttataattacttaacacgtgaagaggatgcagagtaacgtatcgaagctctggttaccttccactgggatttgacacatttgatttcctttattccctccttccttcccttcctccctctctcttttcttaaggaatgcaactactcagattcacctgcacacccttggcatacctctcactcccccttacccccacttcctcagaggtgacctgtcctcagaggcaaatgtgtgccctttccatccgtacttttatgctctcatctatgtttacatctattagtacactattgtctgtatttttaaacattacataaatggtgtaatttttacttttaattctgtagtggtgtttctcaaattaagttctgcacaaaacatttttatagatatccagtgttagcttaacgtttttcttattgtggtaaaatatacataagataaaatttaccattttagccatttttaagtttacaagtcagtggcattaagtacattcacagtgttgtataaccatcaccattgtccattgccagaacttttcatcatcctaaacagaaactctgtactcattaaacaatagtttatcactccttccctgcaactagatgctggcaatcaccattctactttctatctctatcaatttgcctcttccatctaagtggaatcctacatatttgtcgctttgtttctggcttttttttcttcttgtgatgctttgttttaattatgttcctggctttcatcatctagcaggctgattccaaggtttgtccatgtggtagcttgtatcactttaatgtttttagagatagttaatattacattgtttatatataccacattttgttttttcattcaaccttgatggacatttgaattgtttccccctttacctgttgtgaataatgctgccgtgaacattgataaccaaatatttgtttgaatctctgatttcagttcttttggttccatacctaggagtggaattgctggatcatatgataattctatgtttaactctttgagggatggccagacttttccaccatagctaaatcattttaccttcccacaagcaaagttcaagggctccagtctctccccataaggtcctttgcacttttttttttgagacggaatctcactctgttgcccaggctggagaacagtggcaccatcttgcctgacctcaagtggcacctgccttggcctcccaaagtgctaggattgtaggcgtgggccactgcactctgccaattttttaatttttattttcatttatttttctttttttaatttttaatttttttattttttgaagggataaggtctcactttgttgcccaggctggtcttgaactcctggcttcaagcaatcctcctacctcggcttctcagagtgctgagattataggtgtaagcccctgcacatggcctttactctcttgatagtgtcctttgatgcacaaaagctttcaattttgatgaagtttattttttatcttgttacctgtacatttggtgtcatatatctaagagaccattgccaaatgcagtgtcatgaagctttccctcagtgttttctttctgcagttttatgattttagctcctaagtttaggtctttgatccattttgagttaatttttgtatacagtttgagagtcacacttgaggctctgggcgcagtggctcacgcctgtaatcccactacttggggaggccgaggcggatggatcacctgaggtcaggagtttgagaccagcctggccaacatgccgaaaccctgtctctactaaaaatacaaaaattagccaggcatggtgatgcatacctgtggtcccagctacttgggaggctgaggcaggagaattgcttgaacacaggaggcggaggttgcagtgagccgagattgtgccactgcactccagcctgggcgacagagcgagactccatcgtgcggggtggggggtaaaagtcaaacttgagtcttttgcctgtggatatccagttttcccatcactatttgttgaaaagactatcctttctcaactgtgaatggtcttggtaccctagctgaagttatttttattattatgttacttaggaatgcacataaggcctggcacggtggctcatgcttgtaattgcagcactttgagaggtcaaggtgggaggattccttgagccgaggagtttgagaccagcctgggcaatatagcagcaagaccccatctctatattttaaaaaaagaagaaaaaaaaacctctgatgcataaaatatttaaacttgtatgcattcttttctttctttattttttaaaaattgagacagcagcttactctgttgtccaggctggtcttgaactcctgggctcaagcagttcctctcaccttggcctgcagtgctgagatgacaggtgtgaaccactacacctggcctgcttacagattataaaaagaaaataagtttacaagttaaagacagataaaatgacaaaatcagtaaaattaaaattacttttatggagccgatgatgtttattccagttgctcctctcattgtgaatatggtattgttgctgtggcagatttggaggccgtggcagatttggaggctttggcaatggcttctgttaccttgccatgaggtaactcagttccctcatcacttttctctgagaactataaaaccttggaggggtgccttctgcccttcgcttggcatgtatattatgcagggatcaggtcttactccgttcttgattgttagtacaaattagttaaaattgtattgtttggccttagcctgatggtaaacacaacagcacacgtgggctgtgaaatctctgggcagctctgtgtttctagggaagcatctcgatgatccagaacaggcttatactaatgttttagtgtaattttgaaatgaaaacacagcatttaaaaattcttatagagaatgtatagaccttgagaagtgttagcagacccagtttacgacatgtctcaatattatgaaacattgctttattccctatcctgcttgtacatttaattttttcatccagttttaaacaacttgggtactgtggcctgtgcctgtattcccagctactagggaggctgaggcaggaggattgcttgagcacaggactttgagggctgtagtgagctgtgattgtgcctgtgaatagccattgtgctccagcctgggcaacatagcaagaccctgataccttgggtttttaaaaaacaaaacaagatacatgctgacatttctggtttggcaggcagagcttgttctgctccccaccctcccttttcccatagtaaccatttataggacatctcactgttgtctactctgtgttgcctctgcttccctgcgtggtagatctaggaatcttaggatttcttagttttagctggtgatccgtatctttttcttaattccattgtaacttcagcttttcttattgcttgtaggaaggctgtttccattgaatacaaacaaaataaaagcttttattcttaatcttagagataggatgtttgtatttaaaaataattgtgctgtcaaaattctgtcaagttggcttttaccacattagttttttttaatgtggtttatatgaccctggagtaccttgtcttctcactgttaaattctcaactgagttgtccctatttaaagtgtgagactgtgccagtttgattttaaaatattgcaagtgcgttatggcaagataaaactgcaaagaaagaaccttcatgtccctttgattataaatgcttttggcacttgtttctactttttcctaatgttttttgaggaaagaacctccaactctccagacaggtctgggggcaaatgactaaaacatgaactgaggccctgggctgtctctgtgaggatatcccctctattctctctgaaatgtcccagcatgtggtgcatttcttgttagtgtggactcctctgtatataacacatcttatttatcttctgtgcataacatgaagtagtgccctaatgcaattccaggatgtaattcagcatttctataaaaatacagtgtttttctacatttgcatcaaaaaataaccagataattatatttattaagaaaatagcatttttggctgggtgtggtagctcacgtaatcccagcactttgggaggccgaggcaggcagatcacttgaggtcaggagtgaggcaggcagatcacttgagatcaggagttcgagaccagcctggccaacatggtgaaaccccatctctactaaaaatgcaaaattagcctggcgtagtggtgcatgcctgtaatcctagctactcaggagactgaggcaggagaatcacttgaacttgggaaggggagattgcagtgagctgagattgtgccactgcactccagcctaggcaacagagtgagactctgtttcaaaaaaaaaaaaaaaaaacaaagaaaagaaaagaaagaaagaaatgtatttttggtatttgttttcacaaactagagcatttatgtgaaataacattgctagtattgatattataccatagtataatacttagttcttcagcgatgtatctctgctgatcagctacatgatatctacttgagctgttggattttttttaagaacagtgcatttttgaatgcttttgaaaaattgtagtaaaatacataaaacaacatttaccttgtaagcattttaattggtacaattcagtgacattaagtacagtcccagtttagtgcaaccactgttactgtctagtttcagaacgtttttgccccagatggatactctgtacctgttgaacattcagtcctcatggcccaataatctttatgtctgtatagatttgcctattctgcatattttatataaatggaatcatgtcttttgtgtctggcttcttttacctagcatagtattttcaaggttcatccatgttgcagcatgtttcaatactttgttcctttttatgtccattgtatggatatgccacatttcgttaatgacaattcttttgggtagctacattttaaaacattatagtagaatacatatagcatacaatttactatcttaaccatttaagcctgcagttcagtggcattaaatacattcacgttactgtgcaattatcaccaccatctgtttgcagaaacttttcatctcctccatttgaaactctgtatacattaaacatgaactctcccttctccccttcctccagccctggcagccaccgttctacatttttatctttctgacagagattttactactctaggtacctcacataagtgaaatcaaccagtatttatccttttgtgaccagcttatttcattagcttaatgtcctcaaggttcatccatgttgtagcatatgtcaacatgactttccttttaaggttgaataatattccattgtatgtatatgtcacaatttgtttctccatttatccatcactggacatttgggttgcttttacctatcggctgtcttgaatcatgttgctatagctgtacaagtatctatttgagtttctgctatcaattctttaagtatatgcccagaagtggaattgctggatcatatggtaattccgtgtctggttttttttttgaggaagtgccatgctgttttccacacagctgtaccattgtacattccccccagcaatgtacgagggctctgatttcttcacatccttgctaacacttagtattttttttgatagaatagccatcctaatggctacttttaaagtatgtttaacattatttatttatttttaattttttttgtagagatggcatcttactgtgttgcccaggctggtcatgaactcctgggctcaagcagtcctcctgcttcagcctcccaaagtgttcggattataggcgtgagccaccatgcccagcccaaatttaaatatataactaaacacatagcagctaacaccaagcctttaaaaatatcattaataggccaggcgcagtggctcatgcctgtaatcccagcactttgggaggccgaggcgggcagatcacctgaggtcgcgagttcgagaccagcctgaccaacatggagaaaccctgtctctactaaaaatacaaaattagccgggcatggtggcacatgcctgtaatcccagctactggggaggctgaggcaggagaatcacttgaacctgggaggcggaggttgcggtgagtcgagatcgcaccattgccctccagcctgggcaacaagagcaaaactccatctcaaaaaaacaaacaaacaaacaaaatatatatatcattaataggccgggcatggtgtctcacgcttgtaatcccagtgctttgagaggccgaggtgggcagatcactggggtcaggagttcgataccagcctgggcaacatggtgaaaccctgtctctgctaaaaatacaaaaattagccacgcatggtggtaagcacctgtaatcccagctactcaggaggctgaggctggagaatgcttggacctgggaggtggaggctacagtgagctgagatcacactccagcctgggtgacagagcaagactctgtctcaaaaaaaaaaaaaaaaatcattaataaatgtgatcttttttcttcctatacaacaagttgtcaagcaagtatgaccttcttaattgaccctttgacatgaactgggatgagatcgtggaggatgttgaggagacagttgttaccatagtgcacttctaaaaactttaattctatagatttctttaaaattttttttaaaattattatgagtacacaataggtgcatctatagatttcattaccctcaaataaatgtacaaggcaatgcagagaaatgcacagtgtaacttggtagacttgacctatcaagttactgttgaatatattatggagcctgtgtattaccaggggcagcagacttttcctgtaaagatagttgttttcagctttgttgaatctgtggtctctgtcttaactacaactgagaaagccattgacaatatatagatgaatgtacatgactattctaataaaactgtgtacactgtaatttgaattgcacataattttcatgtgtctcctgtataattcttcttttgacttcttttcaaccattaaaaaatgtaaaaacaggccaggcgtggtggctcatgcttgtaatcccagcactttgggaggctgggtggattgctggagcccaggagcttgagatcagcctgagcaatgtgatgaaaccctgtctctacaaaaaattagctgggcatggtgttatgtgcctgtggtcccagctacttgggaggctgaggtaggaggattgcctgaacccgaggaagtcaaggctacagtggtttgtgccactgcactctagcctaggtgacagagtgagaccctgtctcagtgaatgaatgaatacattattagcttgtggactatacaaaaatcagaggctggaggtgagctgggtatggccattgggtgtggtttgctgacttctggtagagaggaattaggagatgttaaaggtggtggaactgtcagatacttgcattcttttagaaatactttggagttagctttttggttcaggcaaaggaccaaagggttaggagagtcaggccggtaaagaggagtggtgggcccatagcagcagttcctggagttttttttttttttttttttttgtgagacggagttttgctctgtcgcccaggctggagtgcagtggcacgatctcggctcactgcaacctctgcctcctgggctcaagcaattctcctgcctcagcctcccgagtagctgggactacaggtgcccaccgccacgcccggccaatttttttctatttttagtagagatgggatttcaccgtgtttgctaggatggtctcgatctcctgacctcgtgatccacctgcctcggcctcccaaagtgttgggattacaggtgtgagtcaccgcgcctggccaggtcctggagtctttaagaggaggtttgtctgatggttggttggacaaaagcctgggcatgttgtcaccttccataagtgtttgtgggaatgtaggtaatgaggaggagtaaaggattcctgaaggatgaggaggagggctggtggctgccataggaagtgatcactgttttggcagacctgtcttagagtaatgaccgtcatactctctcattgcccttgtgaactcatgaaatcccatggctgctaaagctgaaggtcaagtggggacttcccggccactgggcttagcaccccacagagctgtggagtgggcattaatgtcccttttttatagatgcggagactgagaatgaggactgttggtaacttttgaaagggcactcagctagaaaagtctgagccaggatttcaagtcccatggctttacctc

SEQ ID NO: 1140 - DNA, 12580 bp, Homo sapiens
ggttcattaatgtgctggtctttctatttttcttgttatacttagtcacttaaaaacccttttttttttttttttggaattcttatttttacagtactttgaattcctgttttattaatcaccttcttatctgaaagtgaagtaatagtgtacttggcaccattgaattagaaaattgtgtgtccttggccagaagatcacatacacaggaactcgataagttgagagatttagccgtttcagaaatgggcatttgtgtcttccagtggagaagcatctgcaaaagaattgggcagatttggccaggcgcggtagctcatgcctgtaatcccagcactttgggaggccgaggtgggcagatcacctgaggtcaggagtttgagaccagcctggccaacatggtgaaaccccgtctctactaaaaatacaaaattagccaggcgtggtggctaacccatttaaagtgggtgaattatatcttttatgttttaatgtattcctagagttgtgcaaccatcaccagaataagttgtagaacattttcatcaacccaaaaagaaactttgtattcattagtcgttcctcctcatttctcccctaacctcccagcactaggcaaccatcagaatactttttgtctccacggatttgactgttttggacatttcatattaatggaatgcacaatacagtagtataatacattaattttggaaggccaaaattaatggcttttgatgtctgccttttttcacttagaataatgtcttccaggtccatctgtgttatagcatgtatcattactttatcctttatgtggctgggtaatattccattgtatggttataccatgttttgtttatctattcatcagttgatggacatttaggttgttttccattgactattaagagtaatgctgccggccgggcgcggtggctcacgcctgtaatcccagcactttgggaggctgaggcgggtggatacgagggtcaggagatcgagaccatcctggctaacacggtgaaaccccgtctctactaaaaaacaaaaaattagccgggcgtggtggcgggcgcctatagtcccagctacgcaggaggctgaggcaggagaatggcgtaaacccgggaggcggagctggcagtgagccgagatggcgccactgcactccagcctgggcgacagagcgagactccatctcaaaaagaaaaaaaaaagagaataatgctgccatcatgcttgagggtttttttttattttgttttgttttgtttgtggggggagcggagggcacagtctcactctgttacgcaggctggagtgtagtaggcttactgcagcctcctccgccccctggttctagtgattcttgtgcctcaggctcctgagtatcatgctgcaatttttgtgtgagcatacatttttcatttctcttgggtcaatatctaggagtatccccacttttggttctgagtgttaattgagcctgttgtgttctcacattccctgtacttagatggaaatagtgctttgcctaaaaagaaaataaaagacctgattgtgcaggcgagtgagaaagagagagaggcgctagggttatttccaccctgatactctttgggtagtcttggtatgactagcaaagaagcaagctccaagttgtagtttgcttccaagtttctggcttctgtgggaatttctgcatctaagtaatgacaattttcagttacttgcagtaagtaaattatcaaccaatcttactgtgtattactagcctagtaggaatttacttgtatatcgagaggaatgctgcagctttcaccttacttctaatggggattaatgcttacttaacttgcagttttggaggcaagtacaaagtacaggaccaattatggtcatgaagtgagagagaagtctggctagtgaatggtgattggcaactccagttgactgttcatggcatcttagatctgtgaggagggaggagggaaggaaagttcaagctggtctttatggtaagttctggaacatttccctgtgtcaatgggtcatctgttcattcactgtgtaaaatggttgagggaagttttaatttacatgcttccttattgtgtaaacctttgatttttagtgatttcagagtttgtttttataattacttaacacgtgaagaggatgcagagtaacgtatcgaagctctggttaccttccactgggatttgacacatttgatttcctttattccctccttccttcccttcctccctctctcttttcttaaggaatgcaactactcagattcacctgcacacccttggcatacctctcactcccccttacccccacttcctcagaggtgacctgtcctcagaggcaaatgtgtgccctttccatccgtacttttatgctctcatctatgtttacatctattagtacactattgtctgtatttttaaacattacataaatggtgtaatttttacttttaattctgtagtggtgtttctcaaattaagttctgcacaaaacatttttatagatatccagtgttagcttaacgtttttcttattgtggtaaaatatacataagataaaatttaccattttagccatttttaagtttacaagtcagtggcattaagtacattcacagtgttgtataaccatcaccattgtccattgccagaacttttcatcatcctaaacagaaactctgtactcattaaacaatagtttatcactccttccctgcaactagatgctggcaatcaccattctactttctatctctatcaatttgcctcttccatctaagtggaatcctacatatttgtcgctttgtttctggcttttttttcttcttgtgatgctttgttttaattatgttcctggctttcatcatctagcaggctgattccaaggtttgtccatgtggtagcttgtatcactttaatgtttttagagatagttaatattacattgtttatatataccacattttgttttttcattcaaccttgatggacatttgaattgtttccccctttacctgttgtgaataatgctgccgtgaacattgataaccaaatatttgtttgaatctctgatttcagttcttttggttccatacctaggagtggaattgctggatcatatgataattctatgtttaactctttgagggatggccagacttttccaccatagctaaatcattttaccttcccacaagcaaagttcaagggctccagtctctccccataaggtcctttgcacttttttttttgagacggaatctcactctgttgcccaggctggagaacagtggcaccatcttgcctgacctcaagtggcacctgccttggcctcccaaagtgctaggattgtaggcgtgggccactgcactctgccaattttttaatttttattttcatttatttttctttttttaatttttaatttttttattttttgaagggataaggtctcactttgttgcccaggctggtcttgaactcctggcttcaagcaatcctcctacctcggcttctcagagtgctgagattataggtgtaagcccctgcacatggcctttactctcttgatagtgtcctttgatgcacaaaagctttcaattttgatgaagtttattttttatcttgttacctgtacatttggtgtcatatatctaagagaccattgccaaatgcagtgtcatgaagctttccctcagtgttttctttctgcagttttatgattttagctcctaagtttaggtctttgatccattttgagttaatttttgtatacagtttgagagtcacacttgaggctctgggcgcagtggctcacgcctgtaatcccactacttggggaggccgaggcggatggatcacctgaggtcaggagtttgagaccagcctggccaacatgccgaaaccctgtctctactaaaaatacaaaaattagccaggcatggtgatgcatacctgtggtcccagctacttgggaggctgaggcaggagaattgcttgaacacaggaggcggaggttgcagtgagccgagattgtgccactgcactccagcctgggcgacagagcgagactccatcgtgcggggtggggggtaaaagtcaaacttgagtcttttgcctgtggatatccagttttcccatcactatttgttgaaaagactatcctttctcaactgtgaatggtcttggtaccctagctgaagttatttttattattatgttacttaggaatgcacataaggcctggcacggtggctcatgcttgtaattgcagcactttgagaggtcaaggtgggaggattccttgagccgaggagtttgagaccagcctgggcaatatagcagcaagaccccatctctatattttaaaaaaagaagaaaaaaaaacctctgatgcataaaatatttaaacttgtatgcattcttttctttctttattttttaaaaattgagacagcagcttactctgttgtccaggctggtcttgaactcctgggctcaagcagttcctctcaccttggcctgcagtgctgagatgacaggtgtgaaccactacacctggcctgcttacagattataaaaagaaaataagtttacaagttaaagacagataaaatgacaaaatcagtaaaattaaaattacttttatggagccgatgatgtttattccagttgctcctctcattgtgaatatggtattgttgctgtggcagatttggaggccgtggcagatttggaggctttggcaatggcttctgttaccttgccatgaggtaactcagttccctcatcacttttctctgagaactataaaaccttggaggggtgccttctgcccttcgcttggcatgtatattatgcagggatcaggtcttactccgttcttgattgttagtacaaattagttaaaattgtattgtttggccttagcctgatggtaaacacaacagcacacgtgggctgtgaaatctctgggcagctctgtgtttctagggaagcatctcgatgatccagaacaggcttatactaatgttttagtgtaattttgaaatgaaaacacagcatttaaaaattcttatagagaatgtatagaccttgagaagtgttagcagacccagtttacgacatgtctcaatattatgaaacattgctttattccctatcctgcttgtacatttaattttttcatccagttttaaacaacttgggtactgtggcctgtgcctgtattcccagctactagggaggctgaggcaggaggattgcttgagcacaggactttgagggctgtagtgagctgtgattgtgcctgtgaatagccattgtgctccagcctgggcaacatagcaagaccctgataccttgggtttttaaaaaacaaaacaagatacatgctgacatttctggtttggcaggcagagcttgttctgctccccaccctcccttttcccatagtaaccatttataggacatctcactgttgtctactctgtgttgcctctgcttccctgcgtggtagatctaggaatcttaggatttcttagttttagctggtgatccgtatctttttcttaattccattgtaacttcagcttttcttattgcttgtaggaaggctgtttccattgaatacaaacaaaataaaagcttttattcttaatcttagagataggatgtttgtatttaaaaataattgtgctgtcaaaattctgtcaagttggcttttaccacattagttttttttaatgtggtttatatgaccctggagtaccttgtcttctcactgttaaattctcaactgagttgtccctatttaaagtgtgagactgtgccagtttgattttaaaatattgcaagtgcgttatggcaagataaaactgcaaagaaagaaccttcatgtccctttgattataaatgcttttggcacttgtttctactttttcctaatgttttttgaggaaagaacctccaactctccagacaggtctgggggcaaatgactaaaacatgaactgaggccctgggctgtctctgtgaggatatcccctctattctctctgaaatgtcccagcatgtggtgcatttcttgttagtgtggactcctctgtatataacacatcttatttatcttctgtgcataacatgaagtagtgccctaatgcaattccaggatgtaattcagcatttctataaaaatacagtgtttttctacatttgcatcaaaaaataaccagataattatatttattaagaaaatagcatttttggctgggtgtggtagctcacgtaatcccagcactttgggaggccgaggcaggcagatcacttgaggtcaggagtgaggcaggcagatcacttgagatcaggagttcgagaccagcctggccaacatggtgaaaccccatctctactaaaaatgcaaaattagcctggcgtagtggtgcatgcctgtaatcctagctactcaggagactgaggcaggagaatcacttgaacttgggaaggggagattgcagtgagctgagattgtgccactgcactccagcctaggcaacagagtgagactctgtttcaaaaaaaaaaaaaaaaaacaaagaaaagaaaagaaagaaagaaatgtatttttggtatttgttttcacaaactagagcatttatgtgaaataacattgctagtattgatattataccatagtataatacttagttcttcagcgatgtatctctgctgatcagctacatgatatctacttgagctgttggattttttttaagaacagtgcatttttgaatgcttttgaaaaattgtagtaaaatacataaaacaacatttaccttgtaagcattttaattggtacaattcagtgacattaagtacagtcccagtttagtgcaaccactgttactgtctagtttcagaacgtttttgccccagatggatactctgtacctgttgaacattcagtcctcatggcccaataatctttatgtctgtatagatttgcctattctgcatattttatataaatggaatcatgtcttttgtgtctggcttcttttacctagcatagtattttcaaggttcatccatgttgcagcatgtttcaatactttgttcctttttatgtccattgtatggatatgccacatttcgttaatgacaattcttttgggtagctacattttaaaacattatagtagaatacatatagcatacaatttactatcttaaccatttaagcctgcagttcagtggcattaaatacattcacgttactgtgcaattatcaccaccatctgtttgcagaaacttttcatctcctccatttgaaactctgtatacattaaacatgaactctcccttctccccttcctccagccctggcagccaccgttctacatttttatctttctgacagagattttactactctaggtacctcacataagtgaaatcaaccagtatttatccttttgtgaccagcttatttcattagcttaatgtcctcaaggttcatccatgttgtagcatatgtcaacatgactttccttttaaggttgaataatattccattgtatgtatatgtcacaatttgtttctccatttatccatcactggacatttgggttgcttttacctatcggctgtcttgaatcatgttgctatagctgtacaagtatctatttgagtttctgctatcaattctttaagtatatgcccagaagtggaattgctggatcatatggtaattccgtgtctggttttttttttgaggaagtgccatgctgttttccacacagctgtaccattgtacattccccccagcaatgtacgagggctctgatttcttcacatccttgctaacacttagtattttttttgatagaatagccatcctaatggctacttttaaagtatgtttaacattatttatttatttttaattttttttgtagagatggcatcttactgtgttgcccaggctggtcatgaactcctgggctcaagcagtcctcctgcttcagcctcccaaagtgttcggattataggcgtgagccaccatgcccagcccaaatttaaatatataactaaacacatagcagctaacaccaagcctttaaaaatatcattaataggccaggcgcagtggctcatgcctgtaatcccagcactttgggaggccgaggcgggcagatcacctgaggtcgcgagttcgagaccagcctgaccaacatggagaaaccctgtctctactaaaaatacaaaattagccgggcatggtggcacatgcctgtaatcccagctactggggaggctgaggcaggagaatcacttgaacctgggaggcggaggttgcggtgagtcgagatcgcaccattgccctccagcctgggcaacaagagcaaaactccatctcaaaaaaacaaacaaacaaacaaaatatatatatcattaataggccgggcatggtgtctcacgcttgtaatcccagtgctttgagaggccgaggtgggcagatcactggggtcaggagttcgataccagcctgggcaacatggtgaaaccctgtctctgctaaaaatacaaaaattagccacgcatggtggtaagcacctgtaatcccagctactcaggaggctgaggctggagaatgcttggacctgggaggtggaggctacagtgagctgagatcacactccagcctgggtgacagagcaagactctgtctcaaaaaaaaaaaaaaaaatcattaataaatgtgatcttttttcttcctatacaacaagttgtcaagcaagtatgaccttcttaattgaccctttgacatgaactgggatgagatcgtggaggatgttgaggagacagttgttaccatagtgcacttctaaaaactttaattctatagatttctttaaaattttttttaaaattattatgagtacacaataggtgcatctatagatttcattaccctcaaataaatgtacaaggcaatgcagagaaatgcacagtgtaacttggtagacttgacctatcaagttactgttgaatatattatggagcctgtgtattaccaggggcagcagacttttcctgtaaagatagttgttttcagctttgttgaatctgtggtctctgtcttaactacaactgagaaagccattgacaatatatagatgaatgtacatgactattctaataaaactgtgtacactgtaatttgaattgcacataattttcatgtgtctcctgtataattcttcttttgacttcttttcaaccattaaaaaatgtaaaaacaggccaggcgtggtggctcatgcttgtaatcccagcactttgggaggctgggtggattgctggagcccaggagcttgagatcagcctgagcaatgtgatgaaaccctgtctctacaaaaaattagctgggcatggtgttatgtgcctgtggtcccagctacttgggaggctgaggtaggaggattgcctgaacccgaggaagtcaaggctacagtggtttgtgccactgcactctagcctaggtgacagagtgagaccctgtctcagtgaatgaatgaatacattattagcttgtggactatacaaaaatcagaggctggaggtgagctgggtatggccattgggtgtggtttgctgacttctggtagagaggaattaggagatgttaaaggtggtggaactgtcagatacttgcattcttttagaaatactttggagttagctttttggttcaggcaaaggaccaaagggttaggagagtcaggccggtaaagaggagtggtgggcccatagcagcagttcctggagttttttttttttttttttttttgtgagacggagttttgctctgtcgcccaggctggagtgcagtggcacgatctcggctcactgcaacctctgcctcctgggctcaagcaattctcctgcctcagcctcccgagtagctgggactacaggtgcccaccgccacgcccggccaatttttttctatttttagtagagatgggatttcaccgtgtttgctaggatggtctcgatctcctgacctcgtgatccacctgcctcggcctcccaaagtgttgggattacaggtgtgagtcaccgcgcctggccaggtcctggagtctttaagaggaggtttgtctgatggttggttggacaaaagcctgggcatgttgtcaccttccataagtgtttgtgggaatgtaggtaatgaggaggagtaaaggattcctgaaggatgaggaggagggctggtggctgccataggaagtgatcactgttttggcagacctgtcttagagtaatgaccgtcatactctctcattgcccttgtgaactcatgaaatcccatggctgctaaagctgaaggtcaagtggggacttcccggccactgggcttagcaccccacagagctgtggagtgggcattaatgtcccttttttatagatgcggagactgagaatgaggactgttggtaacttttgaaagggcactcagctagaaaagtctgagccaggatttcaagtcccatggctttacctctgtggtcctaatatttggtgtgttcaagtgagatctgtttttttcctatttcattttgattattgattttcataaatttttttctcttttgagatagtatcttctctctcttttcttttttctgttctttctttctcttttctttctttttttttttttctctgagacggagtcttgctctgtcgcccaggctggagtgcaatggtgcaatctcagttcactgcaacctctgcctctcgggttcaagcgattctcccatctcagcctcctgagttgctgagattacaggcacctgccatcttgcctggctagtttttgtatttttgtagagacggggtttcatcacgttggccaggctggtcttgaacttctgacctcaggcgatccacccgcctctgcctcccaaagcgctgtgattatatgcatgagccaccatgcctggccattatttctttctttctttctttttctttttttcaggttcattgaatttgctttgagacagggtcttgctctgttgcccaggctgaagcgcagtggtgcagtcatggctcactggagcatcaatttcctgggctcaagcgatacttgcacttcagcacccctccacccccacccgctcctttcccccacagtagctggaactacaggcgctagccaccgtgcttggctaattttttttttttttttttttttgagacggagtctcgctctgtcacccaggctggagtgcagtggcgcgatctcggctcactgcaagctctgcctcccaggttcacatcattctcctgcctcagcctcccaagtagctgggactacaggcgcccgccaccatgcccggctaattttttgtattttttagtagagacggggtttcaccgtgttagccaggatggtctcgatctcctgaccttgtgatccgcctgcctcggcctcccaaagtgctgggattacaggcatgagccactgcacccggcctggctaatttttaaatttttttttgtagactgcccaggcttgtttaattgattttctatgtgatcttagggaaatcgattatttcccataaacatttttttaattagaagttaaattctgcctagtttgattcacaggattattgtggatgactgaaacagagaataggtaagagcttctttgaaaaatatgaggtaccatacagaagttagatgctttgtcctggtgataccccctccaaagcacagctaaggaaatgtggaaggcactcttatctcatcatatagctttgaaagcctagcattgaaagtacgaacttgattcttttggagaaatcctttggctctcagtgagtttactttctattaatgactgtgttaagcggaatgaaaactgaaagaggaaaggggaggaagtcagaattaagcaggaagagtgagcccatagcagagtccagatttagaccccaagctacttggaatgatactggacaattatgggtgtgtttaatgatggtcctgagtcatgaaaacaaaaggaggctttaaattatgtctggcttagtgtacagcatatttttgtcattattcaagttttagcatgtaaagaggaaagtgtgcagtacttatgcatatcattttcattaatgaaactaaatgaggcctctttaaaattatcagtgttcacagtatcttccaaaagacatgtaaatgtataaaggtataaaaaatatacatataaattttacaattttgtgagctatatagtagatctcttattttgtccataggtcttaaagatcttatactgtattcaggaataaagataacttcagtgggaggcctttacagggctaatgagtaagcattattttgataaagttctgtgttgtctacaatagatatagtagaaatactcttggaatggtaatcatcccaggccctgctttggagcggaagaaatagtcaatgtagaactttacagtatattgtac

SEQ ID NO: 1141 - DNA, 110791 bp, Homo sapiens
gctgttttgtgttatggttgagagttaaaggtatgattgttctactgctctaacttgttttaattttaatgctaaatacagttctgaatacagtagttataacatttgtgatactctgtacatacctacatttatgtttgtgtctgatatcagagataaaaggagcacattttagtacaatctggtccttacattcaaaagcactaatttctttgtctccttcattaaaagctattggttttcaaaacatcaatgcgttttttagcaatgttgtatttcatattgggtcagtctgtcattcggctctattacatgagttccgaaatcatttaggattctctgtttttccagattttgagaatcagaacgttcttttttagttataattaaaatggtagtatcccattgtgggatatattttccattccatatcggaatattgaaaattcaggctgggtggctgggcgcggtggctcacacctgtaatcccagcactttgataggccaaggcagttggatcacctgaggtcaggagtttgagaccagcctgaccaatatggtgaaatcccgtctccactaaaaatacgaaaattagcttggcatggtggtgtgtgcctgtagtccagctacttgggaggctgagacaggagaactccttgaacctgggcggtgaagattgcagtgagccaagattgcaccactgcactccagcctgggtgacagagcaagactctgtctcaaaaaagaaattaattaattaaaaataagaaaaaaaattcaggctgggagtggtggttcacacctgtaatcccagcactttgggaggccaaggtgggcagatcacctgaggtcaggagttcaagaccagcctagcaaacatggtgaaaccccatatctactaaaaatacaaaaattagccgggcgtaatggtgcatgcctgtaatcccagctacttgggaggctgaggcaggagaatcacttgaacccgggaggcagaggttgcagtgagcccagatcttgccactgcactccagcctgagcgacagagtgatactccgtctaaaaaacataataataataaaaaaattttaaatcagtctgaaaaattcacctgagtataattacttgtgggttgatgatgtacctacatttagacatgctacaaattcttaaatattgttcaaagttggctgggcacggtggctcacgcctgtaatcccagcattctggggggccgaggcgggcagatcatgaggtcaggagattgagaccctggctaacatggtgaaaccccgtctctactaaaaatgcaaaaaaaaattagccaagtgtggtggcgggcacctgtagtcccagctactcgggaggctgaggcaggagaatggcatgaacctgggaggcggagcttgcagtgagccaagatcgcaccactgcactccagcctgggcaacagagcgagactctgtctcaaaaaaaaaaaaaaaaaaatatcgttcaaagttgttgagagtaaagacattgaatcacctctttgtgtgcaattcataaatctataaattcataattttatagggctatacctagagctttaatcatatatacactttgcagtcaatatggtaactttttgaagtttaatagcaacaaattggctggacggagtggtgcacacctgtaatcccagcactttgggatgctgaggcgggtggattgcttgagctcaagagtttgagaccagcctgtacatatgatgagaccctgtctctacaaatacaagaaaaattagctggacgtggtggcacgtgcctgtggtcccagctactcgggaggctgaggcaggagctgattgcttgagcccgggaggtccaggctattaacaacttcactctgatttttgagtgcctgttaggtaccacgttttatgagacagcccttgttacttcattgtcctgctgaggaagctgagatttaggaaccttagctgagaggttaaggaacctcttccaggtcattcttttttttttcttttttcttttttttttttttttcctgagacgagtctggctctgtcgcccaggctggagtgcagtggcgcgatctcggctcactgcaagctccgcctcccgggttcatgccattctcctgcctcagcctccttagtagctgggactacaggcgcccgccaccacgcctggctaatttttttttttgcatttttagtagagacggggtttcaccgtgttagccagggatggtcttgatctcctgacctcatgatcggcccaccttggcctcccaaagtgctgggattacaggcgtgagccaccgcgcccggcccaaggtcattcttttagcttgtatttattgaatgctttatgtcatacactgttctagatggtagggatgcaggcgtgaacaagataggccaggtcaatatgttcgtggagtttgcattctagtataaataaatgttttatgtgatattagctatgaagaaaaaagtaaaagcagaatgatatgaggcgttacactaggccagttagtgtggaaaggcctctgtgaggaggtaacatttgagccaagactaaaatgaaggcaggaggagtcacataattatgtcaaaggcagctctctatcctagggctgagtgtgtaaagctctcctattattctgtgatcattacgggaaatcccctattttggtacataatacatatctgaaaatgaaagagccaaaaaatacaatcagccgggattagaatttgaacagaagctgcctctcttctacccgggtaacctaaaagtgggggatcggaatggtataagtcccaggaactgtggggcaggaagtgagtgtatctattgctacgtaacaagttattccaaaactctgtgacttaacaacaacaacaatcatttattatttctcgaagtttcctttggtcaagaatttagacagggcacagtggagatggctttttcctattccacaatgtctaggccagtggttctcaaccatggccacttatcccctcccacctcccacctggggacatttggcaacgtctggaggtatttttggttttacaacttggaaattgcaactggtgtctagagggttgaggccaggaatgttccttcacatcctacggtgcccaggagacccctgcgcacacataaaatgaagaattatctggtccaaaatgtcagtagtgcagaggctgagaaatactagtctagggcctctgctggaagactcgcagagtatgggctggaatcatccgaagtcttgttcactcacgtgtctggcagttggtgcaggggttgtcaggaagaacacccacagtgacctcttcatgtgacgcaggcttcctcataacaggatggctgggttcccagggcggaagtcgagagaaaaaagagcatgcacacatgcgtcagggctggaagtcatactgccttttgtgacctagcccgtcactttgtattctgttggttgaagaagtcacaaagtcccaccctgatttaaggaaaggagaagtagatttcacatctttatgggaagtggcaaggttcttgaagatcacacaggacttgaaatattgccatggccatttttagaaaatacagtctaccacaccaagcaaatctcttcccatcaaagaggttaaggagccaactcccctgggtgaccctcactgtcccttgcacgtgcctgtgccagcataatggcttactgctggtgttctgtttgtcccgtgtgggaagaagggacaataagaaaagtgtgcgaataaggagtaggagtgggaaggggatgctgggtcagttaaagtgatggtgccatcatgtcctggctctgcacaagcaacagtgtgtggctaagcagtgggcttgggttggcaaggaagcattctgactccaccaaaggtagttctacccagcaccctgatggagatctatgaatgacagaattcagtctgcaaaagctagcttaggtttattatgtgctgaagtgtgagtcaaatgaaaacccagtgtctggaagtcaaggactgtctgtagaacacctccttgctgtgattattttaaccacgatcatctttcagacttaggtatagagtgtacagggggctgttaactaaatattttggcttaaatatcgagggtttttttttgtttgtttgttttattaagaatagcatttattaacatttagcatgctttgttttgtttgttgcttctacaaaatagcctatcttggagaaatgcaaattttatatttcatttttgtgttttagattttgctaaacatgttgactttctagaagccataagtagtgctttgagggcccttttgcaaacaatggcctccaagaacatttcccaggtaagagttttaaaattttttgtatgaaacttgtaaagattgtgtattatggaggcaaaattcattacttcactattttaaaaaatacatatttctgttacaagaataatatgtgatctttgtaaaaaataaaacaaaagtgattaaaataaaaagtaatatctttctgctccctaccatcagcaacacacaggtgcttttaatttaattttttaaattttttaatatataggcttactagcaaaacaagtgctttttaatcaatacaacttaattgatagatatgttgtaaataatttctctatcattggtcttttttttaaatcttttttttttttgagacagagtcttcctctgtcgcccaggctggagtgcagtggcatgatctcagctcactgcaacctctgcctcctgggttcaagtgattctcgtgcctcagccacccaagtaaatgggattacaggcatgcgtcaccacaaaatttttgtatttttagtagagacggggttttgccgtgtggccaggctggtcttaaatgcctgacctcaagtgatccacccaccttggcctcctaaagtgctgggatgacaggcgtgaaccaccgtacccagctttttttttttttttttttttaacatttcattacagactttgcaagcatgccctcctgacccttcacagcaatccatgtgcacttcatctcccataggtgccttaccacttttgctactttttactaaggagacttttaaacattcctaaaagcagagataataatgttgctttgttttttgagacggggtcttactgtgttgcccaggctagtctcctggattcaatcctcccacctcagcctcccaagtagctgggattacaggtgtgcgctaccatgtccaaagcagagataaccctatgagcctgcatgcaccgtcgccaagcctcagcaggttattagcgtcctgtcattcttgtgacatggtttcattcatctcactgggtccttatttttgtttcctggagtattttaaagcaaatcatattagacccatcaatattttattatgtagttcagtatgcatgtctgacagaaaaataaatttttaaaaatcttaaccccagtaccattaccccaaggctccaaattaacggatatttcttattatcctttggtttgcactctgagttcagttttcccagctgcagtctaagttcagttttcccagattgccttaaaaatgtattttaacatggccaggcacggtggctcacacctgtaatcccagcactttgggaggctgaggcgggcagatcacctgaggtcaggaagtcaagaccagcctggccaacatggtgaaaccccgtctctactaaaaatacaaaagttagctgggcatggtggcgcactcctataatcccagctacttgggaggctgtggcaggagaatcacttgaacctgggaggcggaagttgcagtgagccaagatcatgccactgcactccagcctaggcgatagagcaagactccgtctcaaaaaaaaaaaaaaaaaaaaacagaaaaagaaaaaaacgtcttttaacagttggcttgttcaaatcaggatctaagcaaggttcatgtgttgcttttggttgatattttggtctcttattatctctaaaaaaaattttactgagatttgattcacataccatgcagtttatccatttaaagtatacagttcaggccagctgcagtggctcacgcctgtaatcccagcactttgggaggccaaggccagtggaccacgtaaggtctggagttcaagatcagcctggccaacgtggcgaaaccctatctctacaaaaaatacaaaaatcagccgggcatggtggcaggcacctgtaatcccagctacttggaaggctgaggcagggagaattgcttgaactgggaggtggaggttgcagtgagctgagattgcaccactgcactccagcctgggcgacagagggagactctgtctcaaaaataagtaactaaagtgtacaattcagtggttttagtatattctcatattcttaaatctcttagtctatagcatttccctcactcccctcctttccccatacacttacccattgaagaaactctcattttgttccgtagcattttctgcactggcagatttggccaactcatcatgatggcatcgttcagcattcctctgtcccccatgtttcctgtgagccgggagctaggtctagagccttaattagatccaggtccagattatttatttatttattttttgtatttataataaataatctagacaggtccagattttttggcaagaataatttatagtgctttatatatttcctatatttatatcacaaatcatatgatattataaaatagtgatgctgagattaattagtgggttcacataatggttttataaccagtgattgtggttgcctggctccattatgtcattagtgggttgcagaatagagataccctaattttgtcttttcttttttttttttttacatttattagctatgatttttttttttttcagaatagctatcctagcaatctctataagtgaccagtgatttttttttttttagtatcattttgaactcagggttttttatatatttgtatttcattccattatagtcatgctttttgctgccaaattcatcccatctttggatagtaggagtcccttcaaattggctcctgtgcctcttttacaagaattttaggtttttgatcacttttgcttccaggcataggatgtcccaggttcaatttgtaattttcttgcttaaaacctggaatctggccaggcacagtggctcatgcctgtaatcccaacactttaggaggctgaggtgggcggatcacttgaggtcaggagtttgagaccagcctgacccacatggcgaaactccgtctctactgaaaattcaaaaattagctgggtgtggtggcacgcgcctgtaatcccagctacttgggaggctgaggcaggagaatcgcttgaagccaggaggtggaggttgcagtgagccaagattgcactgcactccagcctgggtgacaagagtgtgacaagagtgaaactccgtctcaaaaaaaaaaaaaaaaaaccctggaattagttacttctccaagaagctctgatttctttagtggggaaagtgaattgtggagtgcttattgctatcatgttgccattgtttctaggtctttttagtggaaatagctaggaaataggcatttttttaggagacaaaaatagtaagtttatcctgataatttccagtttaaataaaaaatggtacaatatttttacttaattttcgattttgtatttctatctttttgtatcccccaaaaagatacatttgtacccaaaaaggtacattgtacccaaaaagatacattagtgacattaaaattcttatttgcagctggtctgatggtagtgggttatcaggacttattaacattagtgtcactgaagttggtatacaaccccccacgctaagtttgactggctttaaaaataataataaataggtcgggcacggtggctcacgcctgtaatcccagcagttttggaggccgaggtgggcggatcacaaggtcaggagatcaagaccatcctggctaacacagtgaaaccccgtctctattaaaaaatacaaaaaattagccgggtgtggtggcgggtgcctgtagttctggctactcaggagactgaggcagaagaatggtgtgaacccaggaggcggagcttgcagtgagccaagatcgggccactgtaatccagcctgggcgacagagcgatactccgtttcaaaaataataataataataaataatttaaaaattaaaattagagaaaagaaagaaaaatatttttcaaaaattttattatttgctttctcctacagaatgtactttgtagtagtgacattaaaagacattaaaattatttgctatacagtgatattaaaattgtttgctgtagtaacattaaaattgtagtgacattaaaactattatttgctttatcctacggaatgtacttaatagtatcaaaataacaatgctcttgttattgccaataacactatttctttttgcttctttatataatttttttcttaatgcttttaaaatttttttatactttatttttattttttagttttttaatagagatgaggtcttgctatgttgcccagcctggtcttaaactcctgctctcgagtgatcctcttgcctcagctttccaaagctaagaatttttttgaagagcataatttgaccctcagtttctaagaagtaggaatggtaatgggatgcatagcctgccatgtggctgttggatggaccagaaaaccttatactctagggcctataggaatatcaagtatttttattgatttcccctggtatgtaagcagcagcttatgggatcagtgtgatggttaaggaaaattactcaaagcccatgttcagggccaggtgcagtggctcatactaataatcctaacactttgggagcctgaggcgggaggattgcttgagcccaagagttcaagaacagcctgggcaactttgtgagacttcatgtctacaaaaaataaaaatacattagtctagtgtaggggctcacacgagtgataagtagtgaagctaggatttgaacccagggttcaatctccagattccaagcctttgtgtctggctccagattccaagcctttcatcactacactgtgctgctgcttataggagatagtctcactctgttgcccaggctagagttcagtggcacaatctcagctcactgcaacctctgtctcccaggttcaagcgtttcttgtgcctcagcctcctgagtagctgagattgcaggcgtgagccaccgcgcccagccttaaactgaaaattatccactacatggtagaagcaccatataatgtaatggtttctacagtctttaattatgataatacagatatctcaaagtaagttcttaccttgtatagactcagccaatttttttaaaaccacacaatcctatttatactttcaaagcctttttcttaccattaatattaaaaaggaattggactctctttagtgtgtgtacatctggaatgaaagtcttcatcaaattaaatggagcccctttgatattagataacagtgccgacatgagcagggttcaccttagttcagaattaccagctctgtctgggagaactggaatacatattaatagtaacttacctgccaggagtttatgtcactcttaaaatcctgtagcctatagaggagattcctgtcagtccggttttcacatgctgatagaattaattgagtttaacattataaatactgtcctcttctcttttaacagtgcatgactcctgatcagctgatgacattatgcaaagcaggcattcatagtagtaatgtcggggttagagtgaatgtcgttagcattttaggaatcactggcagcgtccttgccaaagaagatggtacacttgaaactcttaaggtaaaacaatttgcttctgacctaacatgttaaataattagaaatgggagaagaactgttggtgtaggatttcttaaaacttgtgtggacttgaagagaagaagtcatatcaagttgctttattgagtcatattattagaatataccctttggcttgatctaactatgtgtattaattaggtaagtatttgaaaagttgagccacattttacaatttaacgttattccagaggtacttttttaaaaaaataaatctgtctttagtgaaagggcaaattcagaatttttaaagatgccttctgcctttgctgttgcatccaatgtatgcatgttacattctcctgctgatgaatgaacaatccacaccattttccttgcacaccaggcaacatgcattctgaaaaatacaacacagttaattaattctaataccactccataaattttaagcagcaaccctggtagtgccaatatactagcaattccctcagcatatttgctcttaccacttagcacagttgctcacaaactgcactgttaggagtacagcgtcactagtaattaaaaggacagtcatagtaacattacactttggtgtgctaataattgctgaagtgtgagactagtggataataaactcattattataaagtacctcttaacctgctaagaactttacaatgatgactgatgtttttaagaatctatttttgaaaaatgatacttgcaaagcttttttttttttctttttttttctgagatggagtctcagtcacccaggctggagtacagtagtgcagtagtgtgatctcggctcactgcaacctccgcctctgggttcaagcaattcttctgcctcagcctcccgagtagctgggattacaggtgcccactaccacacctggctaatttttgtatttttaatagagatggggtttcgccatgttggccaagctggtcttgaactcctgggctcaagcgatctacctacttcagcatcccagagtgctgggattacaggcatgagccactgcacccggcaacagttatttcttagtgtgtctaattcctggtccatattcataattttacagttgcctcaaaattatctgtttacagagagcttgtttacactgctgaagtccacatgttatgtttcctgtggggtcttctctttctctcttaatcttgaacagttcctccccggcaccacgtggttattctcacctcctggatcagttgtccaatatagtgtccaaaaccttctggatttgtctgattgctaccttgtggtggtaaatttgtttttttatccttgtatttcctacaaactgacagttagatctacagactagattcgattcagatcagtcctattttacgttttttagagatgaggtcttgctccattgccgaggctggtcttgaactcctgggctcgagcgaccctcccgccttagcctcacaaagttctgaacttacaggtgtgagccacttgcaactggcctaaagtgtttttcttatgcttttaaaagcagattttttgttgttgtcgttgttgttacagataatatttctatgcatcttgacatcatggagaaatcctttttgagagaggtagaggggaaaatttagtgatttccaaaatcatacatcatttatggattttaattcactttatttatgaatataaactataatatgtttaatttatcttgcttatacttggtatgtttataagtatttaagtctaatctcttgaagttttaatttttccctggcatttgtatataaaatagtatgcatgagttattgccacattcaaagttggtacttgttttggagactggtgttagtcatactaaatgtgttttgttgtttccagaacattgggtgctttctgcttgaagttaccaccaaagatccttcccttgtggtagcaggagaagctttggatgccctctttgatgtttttgcagatggtaaagaagccgaaagagcctcgattcaaattaaattattatctgctctgaaagaattccagccggtctttaaaatgaaggtttgtagccatttaacttataaatacataagtctgaacattctgtggggacaagggtgtgtgtagttaccgctgtgcaactcagaagcatgtgcatgacgaatccccatatgtagcacagcatccccagtactttgtaaaatgttcgttgactgagtcatagctcaacagtgtgactactgaatcattgaaactgaagctaaaatggtatctgacaagttcttctttttttaagtttagtaattttgacaatgcttcatatatgtcagtattatactctgtattttgcaaagcactttcatacacattttgcatttatttaattttacttttttttgtttttttgagacagaatctcactctgtcgcccatgctggagtgcagtggtgcgatcttggctcactgcgacctccccttccccagttcaagtgattcttgtgcctcagcctcccaagtagctgggattacaggtgtccaccacatcacccaaataatttttgtatttttagtagaaacggggattcgccttgtcatccaggctggtctcgaactcccaacctcaggtgatctgcccaccttggcctcccaaagtgctgggattacaggtgtgagccactgtgcccagccatattgttcttaaaggttacagtcctttaaatttctggataaagagcttgcaagataagaaaaaaatatcccctatttccctgcagcttcaaggaaagcagatatattaatagttagagtcatcaaactctgcagaagcaggtgcttaaaaaaggttaaacagtgaactgggaaaataacccctgacttctgaaaggtctttgttctgattgattttcctactcagtatgtattgctgtggtaataacatttgtttttcttttatcaaaggtataaagctctaatgagatttcttcctagccagaggctagcctgtagttatttatgtgaaactcttttttttgctaaatgaagccacaatttgtgttaaaggctattcagtgtatatttagctgcaaaatgcatttatgtacaatcaagaacttctcttgagcagtgtttctcaaaagtgccctccttgtatcagcagcatcagcccttgcctgataacttattcaaaatgcaggtcctcggccccaactcctgacctactgagtcatagactctgtggatgggcccaccagtctatttttcaacaagccttccagatgataccgttgcacactaaaacctgagagccactgctctagactagaggtgagatcaaactcagattccatacaattgatataaaaaaccacaggccaggcgcagtggctcacacctgtaatcccagcactttgggagccccaggtgggaggatcactcgagtccaggatttcaagaccagcctgggaaacatagcaagaacttgtctctacaaaaaaatttttttaagttagccattaagtggtggctcatgcctgtcatcccagctactcaggaagctgagcaggaggatcgtgtgagtgcaggagttggaggctacagtgagctcagtggattgcagcactgcactccagcctaggcgatgaagcaagacccatctctattaaaaacaaaaaacaagcaaacaaacaaaaccagcgctgggcatggtggctcacaccagtaatcccagcactatggaaggccaaggtggtaggatcacttgagcccacgagttcaagaccagcctgggcaacatagtgagaccccacctctactaaaaatttaaaaaaattactccagcatggtagtgcgctgcttgtagtcctagctactgtggtggcagaggcaggaggatcacttgcgtccgggaggtcgaggctgcagtgacccatgactgcagcacggctctctggcctgggcgacagagagagaccctgttccaaaaacaaaaaaaccacaacactacagactaacctctggctaacaaaggaattttttttttaaggtggggtctcactgtgttgcccaggctagtcttgaactcctggactcaagcaaacctcctgcctcggcctcccaaactgctgggattacaggcatgagtatgcacccagcctaacaaaggaatttcattaaggctttatacctttgagagaagaaaaacaattaagtattattaccatagcaatgcatactaactaggaaaatcaatctgaacagcagacctttcagaggttaggggttattttcccaattcatggtttacataattcctttctatagtttatataactcctaccacctgccattcagtcacctttgtaactatcatttttaataatgcacattctcagtttattctttacttaccgagttccatttaccttggaagtaaaaacattttttccaaattcttacagctatctgcttcagcaaatggttaaatacaccctaaattaaatactttatttaaatgaattaatcatatctaccaagtcatatatgattttttgttttttgtttgcagatacgtaaagaagggagaggtaactatagcacagatcagctgtgtgttcttgacaatgtgaaaatgaatttgcgaagatttattgcttatcaagaaactgttgagaaaagactgacttcttaaacaatccaaaaaagaaaccagttcttcccccaaagtattcaatgcttagaatactaaaaggttttctttgaatgtatatgtttctgaaagtcattttttaatgattacattctgtacattctgtaaaaacttcaaaacctggccaggcatggtggctcacgcctataatcccagcaccttgggagaccgaggcgggtggatcacttgaggtcaggagtttgaggccagcctggccaacatggtgaaaccgcatgcataagcatggtggcacatgcctgtgatcccagctactcgggaggctgagggaggagagtcggttgaacctgggagacagaggttgcagtgagctgagatcacgctactgcactccagcctgggtgacagagggagaccctgtctccaaaaaaaaaaaaaaaaaaaaacttcaaaacctgtcagaaactctgttgctggtttttttgtgtgtgtgttttgtttgtttgttttgttttgttgtttttttcttttttgagatggagtctcactgctgcccaggctgtattacagtgctgcgatcttggcttactgcaacctctgccattccaggttcaagcgattctcatgcctcagcctcctgagtagctggaattacaggcacccaccaccacaccttgtttttgtttttggttttttggtttgtttttttttttcagtagagacgggtttcaccgtgttggccaggctggtctcaaattcctgacctcaagtgatccgcctgccctggcctcccaaagtgctgggattacaggcatgagccaccgtgcctggccagaaactcttttttaagtgatgagatctgtgtggcatttctagcgctctctaaattatgtctctggcatattttaatcactggaaactcaaagagtggaagagtggaagtgcgaaggaatctcaggtagctcttaactaattcgccagcagtgaagaaacttcaaccaatcatgttttccttgaattttgcaaagaaagaaaatccaaagcattgcttggatgttcttttaaggcattttatatcagttgaaccttaaactgaaatatgaagacaagctttataaactagttttttgatatgaagtatatcaattatgtttgccttttgtgaagaagtaaatgagttgaatttctatttcacttactagattatactaatgagctaatggggtcattgccatcctccctactcatgactttgatgagttattgctgtaacatcacttcttgatttaatttgatatggaatcagaattgggagaaggtatttttaaataaacaactttttaatggaaagttttgtgtcttacaaaatcttttttaagataccaaataaagggttattagtagaaaatgagatgatactattcgtggatatttgtttgctaatgcatattgcttggaatatatgtgagacattaaaaaaatgacagcacgactttgcagcattacctctcagtgtcttcgaagtactaggtgacagctggggctcgagggagtttccctgtgcatcattgtctcggctgggcctctgaaccggcttcattgtccatccgtttgcctgatgagaagggaaatttgaaaatttctgtacagttgatctcagttgccctgacaaaaggcccaatccccagtacaggacttaattttaattcactgcttccacagcagcacaaaatgagctagtagtgttagatttcatctgcactgtgatgtattttacagttttcacctatatgatatagactgttgggaaaccaagattgtttcccagccctaagagttcctagcccatggcaccaagtaaaataacccaaattgtgtatatggtgggaaaacagaaatgtataccatatacaacacctcgctttattatggtccttgctcatgaattttaaggtatatatgtatgtttagtgatcatttcagctaaatgattggcccaagcatgtctccttggagaacgactcttccaaaaaagaaagtattagagttctctctgcctcaattatttataaaatataattattttcaaggagaaaaaagttcctcattctgtttattcttccccacagtttctgacctataaacaatatccaggatatttagcacaggacctagtatatagtcgactcttcataaatatttgttgagtaaataaatgctggtgattttctcgttgttttgtgtgtgattttctgttttactaagcaagctctaaagcagctgttgaatgcagaatcatccttaaacacggtagaagatgagatgacactgaagatgtgccatcctaaaaatctcttagattctgaggcatggataattgggtctggatttctcccattcaactttaccactctaacgacacaaaagaagggaaaacaactcataaatacagcatacagttttaactatttacataataactcaatagagcatgcaagtattattcatggcacaggataatggagagctttttctgtatgaccataggggaaaaaaagtctgctttaaaatatacttatttgaaaatcacccagaatagcccgttagaaatacacactggaggccaagcattttgggaggtcgaggtgggcagatcacttaaggtgaggaatttgagaccagcctggccaacatagtgaaatcccatctctacaaaaatacaaaaactagctgggtgtggtagcatgcacctgcaatcccagctacttgggaggctgaggcaggagaaactcaaacctgggaggtggaggttgcagtgagccaagattccaccactgcactccagcctgggcaacagagcaagactccacctcaaaaaaaaaataattagccgggtgtgatggcccatacctgtaatcccagctactcaggaggctgaggcatgagaatcacttggatccaggaggtgaaggttgcaataagccaagattgcaccagtgcactttagcctgggcaacagagtgagctctgttaaaaaaaagaaagaaatatacactgttcaggcatagtggctcacacctgtaatcccagcacttcgggagtccaagacgggtgaatcacttgagctctggagtttgagaccagcctgggcaacatagggaagctttgtctctgctaaacataaaaaaaattagctgagcttggtggcgcacacctgtagtttcagctacttgggaggctaaggcaggaggatggcttgagcctaggagatggaggctgtagtgaatcatgattccatcctaagcaacagtgcaaaacctttcttaaaaaaaaaaaaaaaggttgggggctgggcgcagtagctcacacttgtaatcccagcactttagaaggccaagatgggcagatcactagagcccaggagttcgagaccagcctggccaacatggcaaaaccctgtctctactaaaaatacaaaaattagccggatgtggtggcatgcccctgtagtcccagctactgggaagctgaggcaggacaatcgcttgaacatgggaggcggaagttgcagtgaactcagatcacgccactgcactccagtctgggcggtaagactctgtctcaaaaaaaaaggggagctggccgggcgtgaaggctcacacctgtaatcccaggactttgggagggcgaggtgggtggatcatgaggtcaggagatcaagaccatcctgactaacacagtgaaaccctgtctctactaaaaatacaaaaaaaaaaaaaaaaaaaaaattagccaggtgtggtggcaggcacctgtagtcccagctacttgggaggctgaggcaggagaatggcatgagcctggggggcggagcttgcagtgagccgagactgtgccactgcactccagcctgggcgacagagcgagactccgtctcaaaaaaaaaaaggtggggagctgacctgggtgtgtttggctgtgcatatgcgtcatgcaacctgattttaaacttactgtgtataaagctaaagcaatcaaatcatatggttttagcataagtaaagacatacagatcaatggaacaaaattgagtccagaaatagacccataattatatgatcaattgattttccactaaggtgccaagttaacttgatggagaaacaatagtcttttcagtaaatggtgctagaataacgagtatctatatggaaaaagacatactcaagagtcaaagtttgataaattattatttattttttactaattcatcaactacagtcttgggtgcagcttgctttgtttttcctctaagtgcgtgattggggagaatgcagtgataattagtagtttggtgcccatgccctgattcatactagacaccagcagtttcatcccatcactttagtgtccacagccccagtgtgccaccacagcaaaaaaagccaagtcgcatttagtattgtgaaaacagtattgacctcatgacccccccccccgaaaaggatctgtggaacacactttgagaactactggtctagaaagagctagaaagagaaaataaggaggattgagacgaagttgtgaagaaatctagtaagtgctggcctggttggagaatgaacctgaaaagaaacacagaaggagtcccctgagatgtagaaggaaccagaaggctgagtgcagtggctcacaccagtacccctagcactttgggaggcctaggtaggaggaccacttgaagccaggagtttgagaccagcctgggcaacaaagcaagaccccgcctctacattttatacattttattgattgattgattagacagagtttctctcttgttccccaggctggagtacaatggcatgatctcagctcactgcaacctccgcctcccaggttcaagcgattctcctgcctcagccccctgagtagctgggactataggcatgtgccaccatgcctggctcatttttgtatttttagtggagatggggtttcaccatgtttgccaggctggtctcgaactcccgacctcaagtgatccacctgcctctgcttcccaaggtgctgggattacaggtgtcccacagccacagatcctggcctcattttatacattctaaaagaaaaaaaaaaaaaacagaagagtgcagtcaagaagtaagggagtggccaggcacagtggctcatgcctgtaattccagcactttgggaggccagggccggtgatcacttgaggctagaagttcaagaccagcctggccaacatggtgaaaccccgtctttaccaaaaatacaaaaaattagcctggtgtggtggcgcacgtctgcagtcccagctacttgggaggctgaggcacgaaaattgcttgaacatgggaggcagaggttgcagtgagctgagattgtgccattgcactccagcctgggcaacagagtgagaccctgtcttaagaaaaaaaaatttaaaaagaagtaagggagcggcttcagaaggaagaaggggccatgagcatggatgcagttgagagatgcaaggagggatgagggatgtctcttggtttcgaggcatggatatcactggggatcttagcaggggatgtttccatggtgagcaggtcagaagtcaggttggagggagttgggggagtgtgagatgggaggaaatggagccggtgaagtcaaagcagtcttcagaggaacgtatgaaggagaaaacaaagagacagccacagctgaaggaaggagtcacaattgctaatgtcctcctcctgcataaatggatgaactggtgatgcagaggatttggaagagggagcaaaggaaaatgctaagatgacgcttgggtttcccacttagggaatggactgaatagtggtctattgagatggaaaacaaggcctaaggtaggtagaacacacctgtagtttgaggtgagaaagcattttcctacgaaatcttaatttcctttttaaggaagtttttgggttctttactcccaaacctcaaagcctgcctactgcttctgttggtttacacacacacgtacacaatcaagagcttcaaaatcttacatggtcttgttctgttgcccaggctagagtgcagtggcatgaacatggaccactgcagcctcaacctcctggactcaggcaatcctccaacatcagcctcccaagtagccgggaccacaggcacatgccaccatgcccagatcatttttttttttaatttttgtagagacggggtcttgctatgttgcccaggctggtctcaaactctggggctcaagtgatccgcccacctccacctcccaaagtgctgggagtacggacatgagccactgtgtctaacaaggtcttaattttaatgcactttttatcttttttttttttttttttttgagatggagtctcactctgtcacccaggttggagtgccatggcgtgatctcagctcactacaccctcctcctctggggttcaagtgagtctcctgcctcagcctccagagcagctgggaatacaggcacgcaccactgcacctggctaatttttgtattttttagtagagacggggtttcaccatgttggccaggctggtcttgaactcctgacctcaagtgatccacctgcctcagcctcccaaagtgctgggattacaggcgtgagccaccacacctggcctaaaggtctttttatcttgtcccttttgtgaattaaaagtacatattaatttatctaagaacaaaaaaagttacgtcttcatatcatggaagattctcaatttttgctcatcagagaaatgtatatctttaattgggactattttggtccacttaattgagcattttcttcttttagtgaacagaattaacttgagtcattttattctatgcagtgagaaattataaacaagtggttttgagagtttgcttaaatgtatttttatccctcctgctcttatataggagtcctaattatgagaacacagttgccctaaaatttttacattttcagcaatgtatgcttgcccatgaaaagaacacattctttttgaataaagaatctactatcttcaatttcttccatttagtaagagcaaaaccagggccaggtgcagtggtcacgcctataatcccagcactttgggaggctgaggcagacgggttccttgagctcaggagtttgagaccagcctgggcaacatagcgagtcctcatttcaaaaaaaaaaagagagtgaaaccaggaaaaacacttttctactctcatttgtgggaaccaatatcgcgagtttatttaacataaagataattagttattcaagtaaaataagaagaagtttttttttattttgttttgagatggaatttcgctcttgttgctcaggctggtgtgcaatggcacaatctcggcttactgcaacctctgcttcccaggttcaagtgattctcgtgcctcaaactcccaagtagctgggattacaggtgcccgctaccactcctggctaatttttgtatttttactagagacagggtttcaccatcttggccaggctggtctcgaactcctgacctcaggtgatctgcccacctcagcctcccaaagtgctgagattacaggtgtaagccaccgcacctggcctgaaatgaagatatttttgaatgaatgttcttgcattaaaggaataatggccaggcgtggtggcttgcacctgtgattccagctgctcaggaggccacggcaggaggattgcatgagcctgggagtttgaggctgcggtgaaaatacatagataaataaaggaataatggatttgcttttaggcccatcagattttaaattacatatagtggaacaggtacagaacatggagctgaagtgattttcacaaagctgtttcaaataatcaccttcattttttttcattttttaaaagaattttaaataaaaaagaaatagagacagggtctccctttgttgtccaggctggtctcaaactcctgggctcaggcaatccacctgcctcagcctcccaaagtgctgggattacagcgatgagccaccatgtctagcctccttttttctttcaaagatgaatgtacaaaaacggaaattaagtttaaaatcattagagtctttaaaacattacacactgcaatgaaatagacaactgcatattgcacactttcatgaaaatttgcacataaatttaaagcatttcacaatttgacaaaatattctcataaactaccaaaaaagccttaaagctatatgaaagatatggaaatgttcacttttgatctgtcactttcaccttaaataataaggtaaaataagttctgaaaatttcagatgacattttccattgctgtattgaaagaagatatacttcctattttcttaaagttgtgtttaataaaacaggtaatacccatgcatgataaacagttaaaacaatattagaagagaattctttttttgtttgtttgtttgagacagagtctcgctcttgttgcccaggctggagtgcaatggcgcgaactcagctcactgcaacctcagcctcctgggttcaagcgattctcctgcctcagcctcccaagtagctcggattacaggcacctgccaccatgcccagctaattttttgtatttttagtagagatgggatttcaccatgttgctcaggctggtctcaaactcctgatgccaggtgatccacccacctcagcctcccaaagtgctgggattacaggcatgagccaccacgcccggcctagaagataattcttgaaaagtattttgggttgggcatggtggcttacatctgtaatcccaggactttggaaggccaaggtgggaggatagcttgagactagaagtttgaggccacctggccaacacagcaagaccctatttctatttttttttttttaaagaaaagttttgttttgttttgttgagacagggtctggctctgtcacctaggctggagtgcagtggtgtgatcttggctcactgtaacctctggcttaaactaacctcccacctcagcctcccaagttgctggaaccacaggcacgtgccaccatgcccggctaatttttgtacttttttgtagagacaaggtctcactatgttgcccaggctggtctcaaactcctgagctcaagcaatccacctgcctcagcctcccaaagtgctgggattacaggcacgagccactgcacccggcctagatttcttctctttacatttggaaagaaaaataagaaccagaaacctgagtatccctcttgcattctggattttctccttgctttaaagagggctttagaaagaatgggtcactgggtatctggaggccacacgtgattccgtgctcaccacgctggttccctgcaggtgctggaaggtgagaaagtccctgtcccttcctgccttccaagactcactgacaagaatgagaagcctgagaaatctctgtggtatgtgggatgacaccgcccaatgaattctgaaagaaacaggagaaaagaggcactaaagcctatgtagaagcttgaggaagagaatgtggcctgtgcagttggagtcccgccttcctgccctcatcctgacattctggtgacaccagcctgacttccagctgccacccactgtatttccctgcctgaggacttccttgagcccccaggtcctcctttgccacagaatgacaggtcagaagtgcagggagtggactaacctgccccaatccctccatggatgactgacaggtggaggtgcacaaaggtcccacactcctgccccttaggcaggaggatcagatgcgcattctacattggctcccagagttctctagcagattaggttttagaggctcccaggggaccctgctggaaaacacacccactgttgctcccatcccttccctactggaattcccctctgcccactgtgtttcttgggattacctacctcccacacgactggttgcacttgaaaccttgggagaactcaaggcaacgcaagacatatttgagttatatagatagacagatagagggagagagtgtgtgttttgttctgttttttgtttttgtttgtttgtttgttttgttttgttttgtttttagtgctgaagtctccctctcacccaggctggagtgcagtggtgcaatcatagctcactgcagcctcaaaaactcccaggctcaagagaacctcctgcctcagcctccaagtagatgggactatgggtgcccacagccactcctggcaatgttttaaaattttttaattttaattttttttttttttgagacagagtcttgctctgtcaccaggctggagtgcagtggcacaatcttggctcactgcaaccttccccttctgggtccaagcaattctcctgcctcagcctcctgagtagctgggactacaggcatgtgccaccattcccagctaatttttgtatttttagtagagatggggtttcaccatgttggccaggctggtcttgaactcctagcctgaaatgatccacccactttggcctcccaaagtgctgaaattacaggcataagccacgatgcccagcttttaagttatattcaagttgttctttgaagtaggggaaatgtctttctgtgtgtgtctaagatatgcaagttcataaatttacattctgtgtgtgtaagagttctattcattagtcacacctgtggagtagtgcttgtcaatgtgtagggcaattatattagatttcttgccttaggatagaagataattctcctggccaggtgcagtggctcacacctgtaatcccaacactttgggaggctgagacaggcagatcacctgaggttagaagtttgagaccagcctggccaacagggtgaaaccccatctctactaaaaatacaaaaattagccaggtgtggagtgcgcacctgtaatcccagcttctagggaggctgaggcagaagaattgcttgaacctggaaggtggaggttgcagtgagctgagatcccaccactgcactccagcctgggtaacggagtgagacttcatctcaaaaaaaaaaaaaaaaaattagccgagcatgatggcatgtacctgccgtcccagctactcaggaggctgaggcatgagaatcgcttgaacccagtacgtggaggttgcagtgagccaagatcacatcactgcactctagcctgggcaacaacaagagagcaagactctgtcttaaaaaaaaaaaatctagactctgtctaaagaaagaaaaatctagactctaaaatatatatatgtgtatatatatgtatatatgtatgtgtgtgtgtgtatatatatacatatatgtgtgtgtatatatatacacatatatatatataaaaaaacaaaactatagtaaccaaagcagcatggtactgacatataaaaatagacacatagaccaatggaacagattagagaacccagaaattaatccacttatctacagccaactgatttttggcaaaggtaccaagaatactcactggggaaagaacagtctcttcaatcagtcgtgctaagaaaactgaagatccacatgcagaagaatgaaactagaccctcacctcttattctatacaaaaattaactcaaaatggatcaaagaactaaatgtaagactggaacctataaaactaccagaagaaaatatatagacaggaaatgcttcaggacattgtctgtgaaaagattttatgaataagacctcaaaagcacaggcagcaggagactgaggctgcagcgagccttttgtactactgcactccagcctgggcaacacagcaagaccctgtcaaaaaaaaaaaaaaaaaaaagcataggcagcaaaaataagtaaatgggattatatcaaactcaaaagcctctgaacagcaaaggaaacaatcaacagagtgaagagacaaccaacagattgggagaaaatatttgcaaactactcatccagtaggggatgaatatctagaatatacaagaaacccaaacatctcaacagcaaaaaaaaaaaaaaaaaaaaaaaatttccaatctaaaaaatggacaaacgagggccaggcacggtggctcacacctgtaatcccagcactttgggaggttgaggcaggcagatcacctgaggtcgggagttcacaaccagcctgtccaacatggtaaaaccctgtctctactaaaaaatacgagtagcctggtgtggtggtgggtgcctgtcgtcccagctacttgggaagctgaggcagaagaatcgcttgaccctggaagatggagattgcagtgagctgagattgcgccattgcactccagcccgggtgacaagagcaaaactccatctcgaaagaaaaaaaaaaaaaaggacaaatgatctcaaaagaagacattcaaatggccaacaaatataggagaaaaatattcaaaatcattaatcgtcagggaaatgcaaatcaaaaccgtaatgaggcatcatttcaccccagctaggatggctattaccaaaaagacaaaaaaataataaatgctggtgaggatctggagaaaagcgaactcatgcagtgttagtaggaatgcaaaccagtactgccactaaggagaatagttgggaggttcctgaaagaactaaaaatacaactaccatatgatccagccatcccactactggatatttattaaaaggaaaggaaatcagtatatcaaaaagatatcttggctgggcactgttgctcatgcctgtaatcccaccactttgggaggccgaggccagcggatcacctgaggtcaggagttcgagaccagcctggccaacatggtgaaatcccatctctactaaaaatacaaaaataagccaggcgtggtggtgtgcacctgtactctcggctactcagaaggctgaggcaggagaatcacttgaagccaggaagcagaggttgcagtgagccgagatcgcgccattgtactccagcctgggaaacaagagtgaaactccatctcaaaaaaaaaaaaaagacatctcacccccttgtttattgcagcactattctcaatagccaggatatagaatcaaccaagatatggtatcaactttatccggtcatccggaaacaatagatgaatggataaaaagaatgtgatatatttacacaatggaatattattcagccatgttgtcatttgtggaaacagggatcaaactggaggacattattttaagtgaaataagcagggaacagaaagttaaataaacactgcatgttcacattcttttttttttcttcttttttttttttttcttgagacagagtctcactttgttgcccagactggagtgcagtggtgcaatctcggctcactgcaacctccacctctcagattcaagcgattctcgtgtctcagcctctcaagtagctgggactacaggtgcgtgccaccatacctggctaatttttttttcttttttgtatttttatatagacagagtttcaccatgttggtcaggctggtctcaaacttctgacctcaaatgacccacccaccttggcctcccaaagtgctgtggttataggtgtgagccgctgcgcccggcctgcatgttccatattcatatgtggaagctaaaaaaaagttgatctcataaaagtaaaaagtaaaacagaggatactaggagctagggagggtagggagaatggagggatagggagacatttgtcaaggatacaaaatttcagctacataagaggaataatttctcatgttctacacctgtataggatgactacagttaacaataatatattctatagtttcaaatagctagaaggagggccaggcgcagtggttcatgcctgtaatcccaagcactttgggaggccaaggcaggagaattgcttgaaccaaggaggcggaggttgcaatgagccgagatgcactattgcactccagcctgggtgacaaagtgagactctgtctcaaaaaaaatagaaaaagaaaaagaaatagtgaaggggccaggcgctgtagctcatgcctgtaatcccagcacattgggaagctgaggtgggacgattgcttgagatcaggactttgagaccagcctgggcaatatagtgagaccttgtctctataacaaaatcaagaaaattagccaggcatggtggcatgtacctgtagtctcagctacttggagaatgaggtgaaagaatcgcttgagcctgggaggtcaaggctgcagtgagctgatttcatgccaccgcactccagcctggctgacagagcgaaattctttctctccaaaaaacaaacaaacaaacaaaaaaaggagtgatgggagggatgtgtgatttttgttctttgaaatgtgttgagataggggctgggtgtggtggctcacatctgtaaccccaccactttgggaggccaaggtaggtggaccacctgagcccaggagtacaagacccacctgggcaacatggtgaaacaaaaaaataaccaaagaaattaaccaggtgtggtggcgtgtgcctgtattctcagttacccgggaggctgaggagggagaattgctttaggccaggaggcagaggctgcagtgagccaaaatcacaccactgcactccaacctgggtgacagaaagagacccatctaagaaagaaagaaagatagaaaggaaggaaggaaggaaggaaggaaggaaggaaatatgttgagaaagaaagaaaaagaaagaaagaaagaaagaaagaaagaaagaaagaaagaaagaaaaagaaagaaagaaaaagaaagaaagaaaaaggaaagggaaggaaggaaggaaagaaggaaggaaatatgttgagatagatccttcctgatcattcttctttcctccttctcatcacttgggaatctgaggatgtggcaccaggattctctgctccaggaacaccaatttccccacttgagttacccatcctttgtgtctcttctccaggagctcgcactccaaccaattaagaaaagatttggctacaatgacacattggctggaagacacacccacaaacccatggaccaccggactgtgagtaacagtccttacttatgcctccttgcaccccagtgttaaatattggtagaatgaataaatgaatgaatgaatgaaaggcaaagacagctatttagtcaagtacccagatatttcttgaaaaggatgttattgtggccaagaggctgtgtgccaccttatttatttatgtatgtcacccagactggaatgcagtggtgcaataatagctcactgcagcctctaactcctggcctcaagtgatccttccagcttgacctcccaaagctctgggattaccaggtgtgagctttgcctggcctaagcataacttttgatcttcataggatccaaagtcatgaacttgtagccacgttgacaacttgtccggcttgaacagattgaataatcaagcagacgtagccatagtgtcacctgtgagaaactgcaatattttatagctgctttgtttgtttttttgagatggagtttcactatgttgcccagggtggtcttgaacttcctggactcaagcaatcctctcgcctcagcctcctgagtggctggaactatagggactcaccactgtgctaggcaaaattgtaatgtcttacagacacatacacacacacaaaaaaaactaattatgatttaaaaagctagacagagataatatcttataactcaaggtttttcagccatcaacacatagatgttgattaatcattcaacattaattatggttgtgtttttcaggtcctgttttagaactttgaacaggtcaataatcttgtattgctgtggtcacagtcccttgctaattactgaaggtaaataagatgtgatcacaagaaacagtccactcactgtgtctcacatattctctatagccctaagagaaatgacttccattatattttaagttggttatattggctagtttctttcttttttctttttttttttggagatggagtcttgctctgtcgcccaggctggagtgcagtagcacgatcttggctcactgcaacctcctcctcccaggttcaagcaattctccagcctcagcctcctgagtagctgagattataggtgcccaccaccacacctggctaacttttgtatttttagtagagacagggtttcaccatgttgtccaggctggtctcgttctcctgacctcaagtgatccatctgccttggcctcccaaagtgctggggttacaggtgtgagtcatcgcacccagctatattggctagtttcaaaacagatcaggggctatccatttgaaaccgtcccactaacatgatatgacaaggtttgtaagtgataagcttggcagcttcgatttctggcacaaggtgtgtggcctcccagagctctagcctgtcctctctgactcagtttttcttgctctgtaatgggttctgtccatttgtcagcctgcagattttcagctggatttttttttcatgtcagccaaataaatacagaaattgctccccccaccctgattataatcattttggccacatttttcaaagcttactcttagaccatcccaaaactccagggtaactccatattattattcaaattttttctcaaattaaatgtctgttaggctggttacacaatcacaataagggaaaagcttggccctttcattttgcattttacctcagagaaggtccttgtggcttgactttgcacattactggaaacagaatttgcctttctgctcctttgtgaggtagtcaaagcacgatgtgcatgtggttccaaacacatttaattctgtagctattcttttgttgaaggcgctcaccacaaaacatcctggagggggattacggggcaggtgcaacagacaagggtgtttcccggatggggaaggcagagcgccaagtaaaggagtaagtgctgaagaagggattttacttgaaattggaagtcataggagctatttggttttgggggtgcatgtttaagtgatacatttatagattaaaaacgaaattcaggccatgtgctgtggctcacacctgtaatccagtacctgcagagcccctcctgccttggcctcccccagaaaaacaaagaatttcagagtcaatagcacgttatgttttgactacatcacaaagaagcagaaaagggccaggcaccgtgtctcacgcctgtagtcccagcactttaggaggctgaggcaggccgatcttttgcgttcaggagctcaagaccagcctggccaacgtggtgaaacctcgtctctactgaaaatacaaaaaaattaatcgggcatggtggcatgcacctgtagtcccagatacttaggatgctgagacaggaggatagttcgaacccaagagacagaggttgcagtgggttgaggttgtgccactgtactccagcctgggtgacagagtgagtctccatctcaaaaaaaacccccaaaacaaacaaatgacaacaacaaaagcagcagaaaggtaaattcttattttcctcttttaaaaaaatttcctttgttttaggaattctttttccagacatgtgtcaagccaagccatgagggccttttccaaggtaaaatgcaaaacaagcgggccaagcttttcccttatttttccctccttgcctaggagtttgagaccagcctgggcaacagagcaagacctcgtccctacaaaaaaatgaaaaaaaagaaaacaaaaacaaaaacaagtggctgggtgcagtggctcatgcctgtaatcccagcactttgggaagccgaggtgggcagatcacgaggtcaggagatcgagaccatcctggctaacacggtgaaaccccatctctactaaaaatacaaaaacaattagccaggcatggtggcaggcgcctgtagtcccagctacttgggaggctgaggcaggagaatggcgtgaacccaggaggtggagcttgcagtgagccgagatggtgccactgcactccagcctgggcgaaagagcgagactccgtctcaaaaaaacaacaaaaaaaagtagctggatgtggtggtgcttgcctgtagtcccagctactcaagaggctgaggtgggaggattgcctgggtccaggaattggaggctgctgtgagccatgatcacaccattgcagatccagcctgggtgacagagcgagaccctgtctcaaataaataaataaataaataacagttcagaagagtataaagtgaaagtctcaatttttcatggatttcttatgctctagttttcctcccctggtcttctgttacttccatgtatacccttctagagatagacgatgtgtatgcacatagacagggcactcttatgactggtaacatattataacattggcccactttgtttgctattttgcttttctgtaacaatatactcattcaacaaatatttattaagtacctaatgtatgcttgaatcctgtcctatgtactcaggatagagcaatgaacaaaccaatcaatattagttttctattgctgtgtaacaaattgttgcaaatgcagcagtttaaagaaacacatttagtctctctcagtttttgtgggtctagagtccatgcactgtttccttgagttatctgtttcaggttcttgccaggctgcaatcaagctatcaacagtgctgtgttctcatctggagactcaactggagaagaatttgcttctaagcccactccagtggttagtggacttcattttcttgtaggaataggatggagagctttggatttttaccagctgttggccagaggtcctcagttcctggaggctgcccctgtgcagttgacaagcagcagcttgcttcaggccaggccagcagaagaaagcatatctgctagcaagacggaagtcttattggctgggcgcagtggctcatgcctgtaatcccagcactttggggggctgaggcgggtgaatcacccgaggtcaggagttcaagaccagcctagccaacctgccgaaaccccatctctactaaaaatggaaaaattagccaggcgtggtggtgggtgcctataatcccagctactcaagaggctgaggcaggagaatcgcttaagccctggaggcagaggttgcagtaagttcacactacagcctgggtgacacagcaagacacacacacaaaaaagcaattatttttgtgtagctctgtgtaacctcgaatttttgggctcaagcaatcctcctgcctcagcctcctgagtagctgggactaaaggcatgcaccaccatgcccagctaattttttttttttttttagacagagttttgctcttgttgcccaggctgaagtgcagtggtgcgatctcagctcactgcaacctccgtcttctggtttcaagtgattctcctgcctcagcctcctgagtagctgggattacaggtatccaccaccatgcctggctaatttttgtattgttagtagagacggggtttcaccatgttggccaggctggtctcgaactcctgacctcatgatctgcccacctcggcctcccaaagtgctgggattacaggcgtgagccaccgcacctggcctgcccagctaatctttaataaactttttatagaaacagggtctcactgtgttgcccaggctggtcttgtactcctggcctcaagtgatcctcccacctcagtatcccaaagggttgggattgcaggaaggagccgctgtgcctggtcaagactgagtcttataaagcaacataatcatgggaatcatatcctatcactttgtcacatgctattggttagatgcaaatcacaggtcccacccacactgaaggagagggaattacataaagacttgagcagcaggaagtggggatcatgggagaggagactatcttaaagtcagtctgccttgcaaaccaagctcctgttcccatggagcttacgttctagtaggggaaacagacaaccaatgaataggcaaataagtgcatgctgggtgctaaaaataagtgctaaagccaaacagtaaatttgggtaaatggagcagatgtaaaggagtgttactgtagaagacagcagtcagggaaggcctctggggcagcaacatttgagcagagacctgaaggaaatgaggaaggcacagagattactgggaaaagaggcaccagcctccaatgagcatgtgcacaggccctgccaagtgagcatgctggagggttctgtaacaatgcagagacccatgtggctgcagcacagtgatccagtagcaggatgcaaggctagagaggagatggggttggaccagatagggccttgcagccgtgttaaggatctgagtgtgatacaaagacattaggaaacatggggcagaggagaaacactggctttccattgcaaaggatcactttgatcctgggataagaacagatggatgagaggcatggctggaaggagagaaaccagtcttaatcatttcagcgagaaacactagtagtttggacccaagtggtgcatttcctggaaagtaggcagctgtcatctaaaggaagagcctgcagcatcaatggtaggttggatgtgtggtgagagtgaagaaaacgttaagggtgatgccaaggattttggcctgagtcacttgaaggatggggtcatcatttattgaaatgcagaagacagtgagagaaatgggttcgaacagaaaaaaaatctggagtttgatttgtttctttttgtattttttctgggagacaaattgttacttacacttgttagcggattctgacttccatgcctaccatcctgcttagagtttgattttattatgtgctgtaagcaaagtgacgttgtcattcttttttttttttttttttttttttggagacagggtcttgctctgctctgtcatccacactgcagtgcagtggtgtgaacacagctcactgaagcctcgatttcctgggctcaagagattccccagccttggcctcgcaaaatgttgggattacaggcggaggaggttccaagcgttgatgtggatgattccagaccaacagttggaaagatatgcagtagcctagacaagaactaggcaagtagggttggggtagaggcttccagcatgtcctggagatataatacggaaggtctggggttttttgaatgtaggaggatcaggaaggtcatacttgtctcctaggcacaaagcagaaggtgactgtcaaaacaaaacaggaacaatagtaaaactgggttctagaaaagagccttggaaacttcttttgtgaccaagtaactctttttcgagaaggcctggactgtgtttcaagctatgtaggcgctgctaagagaacattctggagtacagtgttgacatttagtaagggcctttgtctttttatttcttttctttttttcatgctattctgacagaagagcctttgtccgccggatgcggtggttcacacctgtaatctcagcactttgggaggccgcggtgggcagatcacgaggtcaggagatcaagaccatgctggctaacatggtaaaaccccatctctactaaaaatacaaaaattggctgggcgtggtggcgtgtgcctgtaatcccagctacttgggaggctgaggcaagagaatcacttgaactagggagccggaggttgcagtgagctaagattgtgccactgcaatccagcctggcaacagagcgagactctgtctcaaaaaaaaaaaaaaaaaaaaaagagccttagtctttcaaaacagaaatttgcatggttggattgtttaatgacagaagaggtagcaaatgtcagtgagcaccttctcctttatccatagactacattgcaggggtgagttaaaaagaaagggtaacatggggccaggcacggtggctcacacttgtaatcccagcactttgggaggctgaggtcagagttcaagaccagcctggccaacatggtgaaactccatctctactaaaaatacaaaaaattagctgggcgtggttgagggcacctgtaatcccagctatatgggaggctgaggcagaagaatgatgtgaacccaggaggcagaggttgcagtgagccgagatcattccactgcactccagcctgagtgacggagcgagactccatctcaaaaaaaaaaaaaaaaaaaaaaaaaaaaaacgtaaaatgcacagcactgctagggtgttgcatcttgtttgagtttctgggctttctctccactagagtggccgcccagagaccaacacttgctttgcgtacctctggccaagggcgctacttcctctagtaacaagaaagatgatgggaggatgggaggagctgcctccatggccttgtgaaaacctgaatctgaaaaatgtctgaatttgttaaagaccagtccaaaaatttgagaaaatgaactcattctgggagtgggttttttccactctcattaggctgagctaccaattctttttgggggccttagtgcctgccatggtcaagttctatagaaacaccactcaacacagagttacccagaaaaggcaaagctatcaagatagaaagtagattagtggctgcctagggctcaagtgggtaaaggagtgactgcaaatgaaccttaaagatctttctggggacggaggtattttaaagttggaatgtggtgatgattgcacagctctgtacattcactaaaaattattgaattgtacacttaagatgggtgaatgtcacagtatgtaaattaaaataaatctcttttaaaaaatatttaatcagccaggcgcagtgactcatgcctgtaaccccagcacttggggaggccaaggcgggctgatcacttgagctcaggagtttgagaccagcctgactaacatagtgaaaccctgtctgcaccaaaaatacaaaaattagcagggcgtggtggtgtgcccctatagtcccagctactagggaggctgaggtgggaggatcacttgagcctgggaggcagaggttgcagtgagccaaaatcacaccattgcactccagcctagatgaggagagtgaaaccctgtctcaaaaaaaaaaattaattgacaaataatcactacatatctgtgtgggatgcaatgtgatgttttgatatatgtacacattatggaataattaaatcaagcatatccatcacctcacataatttttttttgtggtgtgaacatttaagatcagctctcttggtcagatgcagtggcttacgcctgtaatcccaacactttgagaggccaaggcaagaggatcacttgagccaggagtttgagaccagcctgggcaacatagtgagaccctatctctacaaaaaatacaaaaattagccaggcgtggtgccatgcacctgttgtcccagctacttgggaggctgaggtaggaggatcacttgagcccagaatattgaggctgcaatgacctgagaccatcccagtgcacaccagcctgggtgaaagagcaagacactctcaataaaataaaatttaaaaataaaataaaatcagttctcttataggtcttgaaaacttattcttctgtatagttgaaacttcataccctttgaccaacatctccccattgccaccccccaccaatagagctcttaaaacactcactgtattagtcagggttctccagaaaaatagaccaatatgattgatcaatctatctgtctatccacctctatctctatcactgtattatcatctatgatgtattttaaggaattaactcatgcgattatggaggctgagaaatcccacactctgcttctgcaaactggagaccctggaaggctggcggtgtaactctgagaactgggaatctgatggtgcaagtcccaggagagggcagaagactgatgtctccactcaaccaatcaggcagacagagcaaactctccctcctctgcttctgttgttctattcaggccctcaatggattggatgacaggactggatgaggacccccacactggggagggccatctgctttactcagccactgattcaaatgccggtctcattcagaatcactctcacagacacaaccagaaataatgttttacgtaggcactccatgccccaatcaagtcaacacataaaaataaccatcacgagtctaccccttgtcaacttgacactcatcctcatctcctgaaaccatacttaatctccaaataatgacaataacaagataataattctgcctaatatgatacatctatcctgtgtgccaccgaaaatgcacaaactctttcccagaaaaggataggaatgagtgatgtttagtcttctctttgatattcttctgaaacttaaagactgtgatgttgcggagacaaaagtgagtccatcttgaatgctgatctgccatactgacttcttactaaccccagtctcatgaatgcctctgattcctactttatttactgtccttggtgtaagaacatgtacacactataaatcctgcctttaggtcaaggcaaccttgatattaccacacaaatcacaggctatgacgcacacagcattcttgcctgttctggagggctgctgtgttaggccgtccctgcattactataaaaaatacctgaggctaggtaattcgtaaagaaaagaggtttgggctgggcgcggtggctcacgcctgtaatcccagcactttgggaggccaaggcgggtggatcccctgaggtgaggagtttgagaccagcctggccaacatggtgaaaccccgtctctactaaaaatacaaaaaaaaaaaaaaaaaattaaccagatgtggtggcaggtgcttgtaatcccagctacttgggaggccgaggcaggagaatctcttgaacctgggaggcggagcttgcagtgagctgagattgcaattctcccacctgcaggctgcaggctgtacaagcatggctctagaatctgcttctggcgagggcctcaggaagcttacaattaccgtgggagctgaagggggagcaggcatgttacataaataaagtgggagcaggagagacggggaaggggtgggtgccatacactttcaaacaacaagatctcacatgcagtcaggtgagagctcacttatcaccaaggggatggtgctgaaccattcatgaggggatctgcccccatgatccaatcacctcccaccaggccccacctccaacactgggaatcattgcaacatgagatttaaaggggacaaaaatccaaactatatcagttgccttgaattgtctctatagagcatagagcccctttccctttggtaggtgagccttgtgtctggggaggaatcgtgctgagatctacctgtcttgctgatgctcaagactaaactactgtgtataagttccctcataaatcacccttcattgacaaactggttcatctgcctcattccttggtttctctgttcctttggcatttgagggctgctttgcatatatgacactttcatagagcagatgtaaaatttttgttgttattgttggttttttgtttgttttctatagagacaaggtctggctctgttgcccaggctggagtgcagtggtgcaatgacagctcacagcagcctcatcctcccaggctcaagcgattcttccacctcagccttctgagtagtcgggacagcaagtgcatgccactacacctggatactgttttttgttttttttctgttttgtttttagtagagatgaggttttgccatattgctcgggctggtttcgaactcctgggctccagcaatttgcctgccttggcctcccaaagttctaggattacaggtgtgagccaccatgctcagctgttgttgttttctgagataaggtctcactctgctgcccatgctggagtgcagtggcatgatcatagctcactgcaacctctacctcctgggctcaagagatcctccctctacagcctcccaagtagctaggactacaggcaagtgttaccacgcctggctatttttttttttaatttttgtagagacagggtctccctatgttgcccaggctggtcttgatcttctgggctcaagtggtcctcccacctcagcctctcaaagtgctgggattacagacatgaacaaccacacgcagccagatataaaattaacaatacttaaatcctatgatacaaagtcaatacatcttatgttacatgataaaatgagaggaaagaaaacaaagatatttgctacacaaacgtgttcataataaaataaggaggaggccgggagtggtggctcacacctgtaatcccagcactttgggaggctgaggtgggcagatcacgaggtcaggagattgagaccatcctgggtacgggtgaaaacccgtctctactaaaaatattaaaaaaaatattagccgggcgtggtgatgggcacctgtagtcccagctactcaggaggctgaggcaggagaatggcattaacccaggaagtggagcttgcagtgagccgagatcacgccactgcactccagcctgggtgacagagggagactccatctcaaaaaataaataaataaataaataaataaataaataataaaaaaaataaataaataaaataaggaggaaatataacaattacagtcctcatttctgtaaccagtcatgtggtcatggctgtgtatttatttataactatcttcctccactaccccattctgtattccttttgccttcagcaaacacctcaggtggtcatggttctttatttggtgttgtgatccaaaccttcattcctgaaggacctgggccatatatagtcctgtctggattggattgttgtatatttttccgttccacttaatcagagggcgtggtcatactgagagatgctctgcaggatctcatgaattgcagacatactctttcttacctccattgtggagtagtagtccaagtttcccttggtagtcagaatcaatttatctagccactagaggattcccttctttttttgttgattcagggtattaaggagcccaaagtggctgggcagtagccttaacttccagctcaatgcaattattgttgtgtctccagatggaagcattccttcttctggaactaagagctctagaccagcagagcataaagttgtgagaacaggaaccaaaaattttgctactgggtcactagaagtaatagtggttcagctgggcacagtggctcatgcctgtaatcccagtgctttgggaggctaaggcaggaggattgcttgaggccaggagtttgagaccagcccaaacagcatagggagacactgtttctaatatatatatatatatatacattttttttctttgtttgttaaacaagctgggcatggtggcaagcacttgtagtcctagctacttgagaggctgaggtgggaggattgcttgagcccatgagtttgaggctatagggagctatggccatgccactgctctccagcctgagcaacagagcaagactctgtctaaaaaaaaaaaaaaaaaaaaaattggtgaagggtgccactcccatttccacccttgattcctgactgtgatttcctgctgtaagagaaacagcaccatggccaggcgcggtggctcacacctgtaatcccaggactttggtagtccgagccgggtggatcacctgaggtcaggagttcaagatcagcctgaccaacatggcaaaacctcatctctactaaaaaatacaaaaattagccggtgtggtggcaggtgcctgtaattccagctactcaggagactgagtcatgagaatcgcttgaacccgggaggcagatgttgcagtgagccgagatcacaccattgcactccagcctgggcgacaagagggaaactctgtctccaaaaaaaaaaaaaaaaaaagaaagaaagaaaaaagaaaaacaaaacaaacagcactgtttttggacgctgattcagagcatatacagccttctggtgaaccttgccctagccctcctagctggtactgtaactaagtcttcaaaagaccctttcactgtttcatcaaaccagctacttcagaatggtgggaaaagaccagtgaattccatgagcttgaacccattgctgcattccttttgctgtgtgttcgttgatgagaagcaatgttgtgtggaataccaataccattacaatggataagacattctataagcccacaaacggtagttttggtagaagcattgtgtgcagggaaggcaaattaatatgctgagtaagagtttattacaagcccacacagtggtgtgcacctgtagttctagctacttgggaggctgaggcaaagtgggaagatttcttgagaacaggagttcaaagctgtagtgtgctataatcatgcctgcaaatagccactgcactccagcctgggcaacacagcaagatcccatctctaaaaataaaaaataataattaaaaaaaatttttaaagaatctattacagtaagaacaaaacactgtcccttccatgatagaagcagtccagtgtaatcaacctgccactggggagctggctgatttaccccccggggaatatcagggactcagtcttggtctctgctgctgatggattgggcactcaccagtggccatagccaggtcagctttgataagtggtagtccatattcccaagcccatgattaacctccatccctgaccatggccactctgctcatgagcccactggctgatgagggggtggctggagaaagaggctgatggctatccacagaataggtcatcctatccacttgatttttaaagtcctgctctactgaggtcaccctttagtgagcattcacatgggagacaaatatcttatgatttttgctcattctgcgaggtctattcacatacctcttctccaaatttccttgttaccagttttccaatcatattccttccaagttcctgaacatccagccaaaccatggtccacagcccatgggattggtatataattgcgtgtctgaccatttcttcttccaagcaaagcatgctgcctgaagttttgccactgggaagatttcccttcactgctgtccttaagggatgtctcagagagaagctgtagtgctgtccactttcagatggcacacacgtattgtgcagaaccacctggaaaccaggcctgtcctatcttcctctgtcagctgattatagggacctccctaagaggccataggtacagaacgggagacagaaggcagtgtagcggggcgggggaccgttggtatttgtgccagtccttcattaacttacttgtgccttcagggcctgcttgaactcaatcatgtatataccacttccatttgatggtggagtgctcctgtgcacatccaaatttatggcattggagatcagatagcccccagtttgtgatgggtagctcaagtcgcattgtaacttggtggccatggttgagcattcagtctttttttttcccgagatggagtcttgctctgtcacctaggctggagtgtaatggcgcaatcctggctcactgcaacctctgcctccagggttcaagtgattctcctgcctcagtctcccaagtagctgggattacaggcacatgccaccatgcccggctaatttttgtatttttagtacaggtgggctttcaccatgttggccaggctgacctcgtgattcacccacctcagcctcccaaagtgctgagattacaggtgtgagccaccacgtctggtcaagcattcagtctttaccaaggctcaggagcaggccaagagctgtctcaaaaggaaagtaagctgaaggatggcagggctctgctgcaaaattctaaggatctgagctataatccacctacaggaacctgctaaagactccaaacagcacccctgtctgccactgacccttcaggcaccattggctctgctggatcatatggcccaaggggcggagcagcttgcacagcagcctggacccattgcagagccttgtccgtttctgagtcccactcaacacttgcagctttttgggtcacccagtaaatagattcgaatatcacacctaaatgaagaatatgttgcctccaaaatccaaagatacccacggggcattgtgcctgtattctgcctgtaggaggggcagatgcaacaacttctccctcaccttagaagggacatctcaacatgccccacaccactggatctctagaagtttcacggaggtagaaggcccttgaatttttgttggatttatttttcaccctctgacatgcaagcgtcttgccagtgagtgtagaatagttgatactccttgcttcctgggtccaatcagcacggtggcttcagtgtaatggaccagtgtgatgtcttgtggaagggaaaggcaattctttgggaatttaattttgttttatttttaataatttttgtcatacatagtaggtgtatatatttatggggtacatgaaatgttttgatacaggcatgtaatgcataatgattacatggggaatggggttccatccccttgagcatttatcctttgtgtaacaatccaattatagtttcagttattttaaaatgtacaattattgttgactatagttaccctgttgtgctatcaaatagcaggtcttattcattctttctaactactgtttttgtacccattaatcatccctacctcccacctcccccactaccctacccttccaagcttctgataatcacccttctactctctatgtccatgagttcagttgttttgatttttagatctcacaaatgagtgagaacatgcaatgtttgtctttctgtgtaaattttgacatagggctagagagttcacatataccccccaggcaggacctgaaggtatattgctggcctgcctgctgaaagaaaactgctcttatgggcctcatggacaggaatttgagggaaaggcgtttgccagttcaatagctgcaaaccaggaaccaggggatgtgttaatttgcttaagcaatgaaaccacatctgatacagcagctgcaattggagtcaccacctggttaagcttgtgataatccaccatcatcctccaagatccatctgtcttctgcacaggccaaatgggcaaactgaatgggaatgtggtgggaatcatcacccctgcatccttcatgtccttgatggtggcactaatctctgcagtccctctaggaatgtgttatgctttgggtttactattttcctagttcaggccagctttagtagcttccacttggcctttcctcccataatagccctcactctgcaggtcagggaaacaatatggggattctgccagcttctttgtatgcctatttcaattacacattctggaactggagaaataactgcagaatgggttgggacccactgggtccactgtgaggcagacttgagctaaaactccattaattacctgacctccataagcccctactcccactggtaggccacagtggcattttgggtaccccagaattggtaacagctcagagctggtgtctagtagtccccaaaagttctgattatttccttcttcccaatgcacaactactgtggttacaggtccctggctataggtccctttggggaagactgggaaaaagattaatagcatacatttttattagccaggcacaggggtttgagcctgtagtcccagctagtcggcaggctaaggtgggagaatcatttgagcccaggagtttgagactgcagtgagccatttaatcccagcagtttgggaggctgaggtgggcagatcatgaggtcaagagtttgagaccagcctggccaacatggtgaaactccgtctccaccaagaatacaaaaattagccaggcgtggtggtgggcacctgtaatcccagctactgcactccagcctgggcaacagagtgagactctgtctcaaaagcaaaaacaaaaacaaaacaaaacacacacacacaaagatagatttttaggagtactggggttattcttcaacaggtccaggtatccccttcattcaagtggtcctgggtcagtaaagtggctgatgtccagcaattcactgaggggttatgaatcaatttttatgatacatgttaaacttttgttcatctgacctagaaattttctgcatatacagatcaagtaagaaaatatttcacttctaggaacaccctgataaacttgccaatgccaaaggtcttcatgagtcagactattctgattgctgccttgattctgctgttcatcatggcaaccacaccccccttgcctctgttggttgagtcccaaaacttggaacctgccactctgggcaggggtgggatccaatgactcccattgcatttaggcttcccgattctgtgagtgcagtttccatcgaaaggccaggcctacagagtagggtgatcacagagctctccaaggatgtgctcccctcatgatgttatgtttcacggtactagtgaaaggtgtgtcttttgaaccttcccagtgtgggtgaataggccttaaatgacaaattcactctagcatgccaatctccctaagcttctgaattcctttccctacataaaaccaaggcaggtacggcatttccaatttgctcaccatggaccaggttttggtccatgttttccatgtttgagccaaccaactgaagtgttagagctttttcttttctttcctttttttttcccccaagacagagtcttgctctgtcacccagactggagtgcagtggctcgatctcagctcactgcaacctctgcctcctgagttcaagcagttctcctgcctcagcctcccgagtagctgggattacaggtgcccgccaccacatctggctaatttttgtattcttggtagagacagggtttcaccatgttggccagactggtctcgaactcttgacctcatgatctgccctcctcagcctcccaaactgctgggattacaggcgtgagccaccttgcctggcctttttgtttgtttgtttgttttttgacagggtctcactctatcagccaggccagagtatggctcactgcagcctcgacctcccaggctcaaatggtcctcctacctcagcctcctgagtagcttggactacaggaacacaccatcatgcctggctggctttttttttgagatggagtctcactctgtcacccaggctggagtgcaatggcacgatcttggctcactgcaacctctacctcccgggttcaagtgattctcccacttcagtctcctgagtagctgggactacaggtgcatatcagcatgcccagctaattttcatatttttagtacagatggggtttcactatattggccagagtggtctcaaactcgtgacctcaagtgatctgcccacctcagcctcccaaagtgctggggttacaggcatgagcaactgtgcccagcaagtaatttataaattacactttaccataggtatgtgtatatagaaaaaagcatagtatatgtagggttcggtactaaccacagtttcagtcttccactgggggtcttggaacatattcccttaggctaagaggggactactctacttgagttttctaatttatatggacagaaatgggagagcatgtgtgagaatggatactaagggtatgcgatgatggtggaaagaacataaggttgggtcaggctaaattaattgatttgggcccactaagcagagattctgcctttaattcttcagtttagggagttagaaaggctctacgacaggtgtggtggctcaagcctgtaatcccaggatgctgggaggctgagaagacaggatcccttgagcccaggactttgagaccagcctgggcaacatagcaagaccttgactgcactaaaaaaaaaaaaaaattaggccaggcatggtggcttgagcctgtaatcccagcactttgggaggccaaggcaggcagatcacctgaggtcgggagtttgagaccagctggtgcaacatggcaaaactctgtctctcctaaaaaaaaaaaaaaaaaaaaaaaaaaattagccaggcgtggtggtgtgtgcctgtagtcccagctactcaggaggctgagacaggagaatcacttgaacccaggaggtggaggttgcagtgagctaagattgtgccactgcactccagccgggtgacagagtgacactctgtctcaaaaacaaacaaacaaacaaacaaaaattaggcaccggaagagattaacaataactaataataaaatagaacaattataacaacatgctgtaatgaaagttgtcagtcactgtagtctaacttgcaatttgaggtgtgacagcaaaactagcatgaatttcattactttttccttcttcacagtttcacagataaaagatttgttcttactatagatcttagcaacctcaacatatgagtttttttctttccttattaagttgagcactttcacctccttacttagaagaagtacttgacagcttttctttggcatatctgaattgccagcatcactactcttactttggggctactattgagtgaaataaaagccacttgcacacaaacactgtgataccatgacagtcaatctgataactgagacagctactaagtgaaaatgagtgaatagcatacacagtgcaggtatgctggacagagggatgattcgcaccctgggtgggatggtgtaagttttttttttaatttattgtgttattttatttatattctttatttcttttaaacaaccctaagtccatttagcaatgacacgatattttatcacactactcagaacaacacgcaattgaaattatgagttggttgggcatagtgattcatgcctataattccagcgttttggaaggccaaggtgggaggcaccattgaggctaagagttcaagaccaacgtggacaacacagtgagaccaccatctctacaaaaacaaaacaaaacaaaacaaaacgatacaaaacaaaaaaattggccaagcttggtggtgcacacccgtagtcccagctaacttgggaggcaagatgggaagatggattgagcccaggagttcaaggctgcagtgagctatgatcacaccactgtactcaagcctgagtggagagcaagaccctatctgtctcaataacaaaagaaaacaaaacaaaacaaaaacagaaaaaaaagtatgagttgcttacttctggaattttccacttaatacttttgaatcatggttgactgtgggtaactgaaactgtggaaagcaaagccatggattggggggactgctgtagttcttttggagcatcgcatccctcctcttgggtcacactttgtacttcgccttagggacctactggtacttgggtctagttacaggtctagaagcaaagggggttgttgaggtggtcccgtaacagaatcagcatagtcttgcctgtcaactgcctcagtggaggcctttacagtttcctcaggcaatgcagagttaattccctgagatggggctgggagagtgatggggagacccataccactggggtagggaggcctcttccactggcaatggagatacatcagactttcggggctcaatgtctcttatcaaggtcttcccgcacatccctatttcaatttccaggatcctattgtttcccaatcaatatgctcactttaacagtagatgccctgtgaggctggatacaattcagtcagtcacagaatgaggttctgcatttgattttcagcagtctcagctctgtggctataggagacagaagtcttcttcaggctcacatacgagctctaaagaaatctgctttaccaacgctgtcacagatacacccagaaataatgtttaatctgggcaccctgtatcccaataaagttgacacataaaattaactatcacacaccaagaccccaaagtggcttgtaaactgagcaagtttgtttctagaacagtagaaataaaagacattttggctgggcaaggtggcttatgcctctaatcccagtgctttgggaggctgaggcaggagggtcgcgtgagtccaggaattcaagaccagcccatggtaaaactctgtctctaaaaacaaaaaacaaaaaacaaaaaaaaaaaaaaaagaaaagaaaaaattagctgggtatggtggtgcatgcctttagtcctagctactcaggaggctgaagtgggaggatcatctgagcccaggaggttggtggaggctgcagtgagccatgattgggccactgcactccaccctgggtgacagagtaagaccctgtctcaaaaataaataaataaataaatttggattaccctgaacaagatacaagcttcaacattgctaattatttttaagtctcactgaaaaatatttccctacttggaatcctcctggtatttatgaaggagaaaaataacatgaaacaataacatatattttgtgcaaaaaggggaaggtttgtaaatggggcctaagattattcataactggagcaaatgcttcataatgtaaatgatgaagatactaatattaagaaactattatttatggtttttactaactccagaataaagtactttaatcacatactgtcaaaaatttagttgtaatgacagcttgtttttttgagacagggtcttgttctgttgcccaggctggagtgcagtggcaggattatagctcaacccaggagtaaccttgaacttctgggttgaaggaatcctcctgcctcagcttccacagtagctgagactactggtgcataccccaccacacccagctaattttgtcttattgttatttattattattattattattttgagagggagtttccctcttgttgcccaggctggaatgcaatggctcgatctcagctcactgcaacctctgcctccaaggttcaagtgattctcctgcttcagcctcctaagtagctgggattacaggaatgtgccaccatgcctggctaattctgtatttttagtagagacagggtttcaccatgttggtcaggcttgtctcgaactgctaacctctggtcatccgcccgcctcggcctccctaagtgctgagattataggcgtgagccaccacgcccagcctattttattttttgtagagatggggggtctcatcatgttgcccaggctggtcttgaactcctggctgaagcaatcatatcctcctcagcctcccaaagtgttgggattacaggcatgagccaccacatcctgccttaatgacaattattaataataccaggtagtagttgtggaatttccctcctgttttgttcaagttaataaatcaaggccgggcatagtggcccacacctgtaatcctggcactttgggaggtcaagatgggaggattatctgaggccagcagttcaagaccagcctgggaaaacctgcagatttaccagggaagtaggaggctggactaacatagtaatgccagcccaggtgggaggattgcttgaggccagaagttcaagaccagcctgggcaacgtaggaagacccccatctctacaaaaaaatgaaaaaattggcctggcatggtggcacatgcctgtagtcccagctacttacaaggctgaggcaggaggatcacttgagcccaggagttccaggatgcagtgggctaaggtcacactactgcactctagcctgtgacaaagtgacacttcagttctaaaaagaataaataactaaatgaaaacacatttaaatttgcatgattcttgggtagttttctttcttatttctctactaaatttttactctgtagaactttggcatttcagtaaatcttacaagttaagactatcaattcaacatctttcttgcctaggaagaaaaatattgagaatgaacggggtgctaaattgtggaggaacatgtctggggttgtgatagctgcgttttttggcttatcaatgttgacgattttcaagactccaataaatgtctgctcttttgttctaaatagcaaaatgaaaacgctgagtaaaattgattattgaaattggtgttgtctattttttaaaatgcagtagtagattatttgggataaaacattgaagatttgttggggaaagtgaatgcagttgttccttgaactgtgtgagttcacttatatgtggatattttcaataaatatatgggaaaaattttcagagatttgggacaatttgagaaaacttggagaatagcctagaaatggcaaaaaaaaaaaaaaaaattaaaaaagttggccaggtgcagtggctcatgcctgtaatcccagcactttgggaggccaaggcgggtggatcccctaaggtcaggggttcgagaccagcttggccaacatggtgaaaccccacctctactaaaaatacaaaaattagctggatctggtggcacacccctgtaatcccagctacttgggaggctgaggcacgagaatcacttgaacccaggaggcggaggctgcaatgagccgaggtcacgcccctgcactccagcctgggtgacagagtgagactctgtctcaaaaaaaaaaaaaaaaattaagaaaagtcaggtaggaatgcacaagatatgtgtagacactagtgtattttatcatttactaccataaaatatgcacaaacctgttataaaaagttaaaatttggccagtgcggtggctcacacctgtaatcccagcactttgggagactaaggcgggtggatcacgaggtcaggagctcgagactagcctggccaacatggtgaaaccccgtctctactaaaagtacaaaaattagccgggtgtggtggcaggcacctgtagtcccagctacccaggaggccgaggcaggagaattgcttgaacccgggaggcagggattgcagtgagccgagatcgtgccactgcattccagcctgggcgacaaggcgagattccatctcaaaaaaaaaaaaaaagttaaaatttgcccaaactgatgcacaaatatacttacagattatacatggcatcactcacagttgaaaaaaatgtaaacaaacaaagatgcgatagtaaatcataactgaaaaaaattacctgtagtacatagtgcagtactataataattttgtagttacttctagttgttattgagaacatctgcttaaaacaccaggtaccattaatcatctgtgtgagcagttgtctctttggcaaactgtacagagcagtgaaaagtgatctctctcagttctcgagtagaaaccttgtatcacttatgggacccattctaatgatgctggaagtgctcccaaggagcagaggaaagtcttgacattagaagaaaaagttgaattgcttgctatgtaccctacccagattgaggtctgcagctgtgggtgcctgccatttcggatagatgattcgtcctgtaaacagatgacatgaagttaaggtatcaacaaatatagtacagtactgtaaatgcattttatcttccttataattaatttattttgagatagggtcttgctctgctgcccaggctggagtacgggtggcacgatcttgactcactgcaacctctgcctcctgggctcaagaaatcctcccgcctcagtctcctgagttgcgactacaggtgtgtgccaccacagccagctaattaaaaaaatttttttgtacagatgagatttcactatatgctcaagctggtctctaattcctgggctcaagtgatcctcccacctcagcctcccaaagtgctgagattacaggcatgaaccactggggctggcctcttataatttatttagtaacattttattttatttccttttttttacattttattttctttagcttactttaagaatacactataggctgggggcagaggctcatgcctgtaatctcagcattttgggaggccgaggcaggcggaacacctgaggtcaggagttcgagaccagcctgaccaacatgaagaaatcccgtctctaataaaaatagaaaaattagccaagcgtgatgatgcatggctataatcccagctactcaggaagctgaggcaggagaatcgtttgaacctgggaggctgaggttgcggtgagccgaaatcatgccattgcactccagcctgggcaacaagagcgaaactccatctaaaaatatatatatatatataaaataattttttaaataataatataaaatagtataaaattatttacattttatatcactatataatatataaacatagtctcactatgttgcccaggctggtctcaaactcctggactcaagaaatcctcccacctcagcctccaaactgttggaattacaggtgtgagctatggtgcacagcctggtttttttttttttagagacaggatctctctctgttgcccaggctgaaatgcagaggtgtgatcatagctcactgaagccttgaactcctggcctcaagcaatccaccggccttggccttccacagtgctgggattacaggcatgagccaccacacttgtctagtagttaaaattttgaggaatcaaaagttatatgctggccaggtgtgatggctcacatctgtgatcccaacattttgggaggctgaagtggggaggactgcttgaacccagatgttcaagaccaaccagggcaatatactgagaccccttctctaaaaaaaatagaaaaagttaggtgggtttgacagcacgcgtctgtagtcccagctactcaggaggcagaggcaggaagattacttgagctcgggaggttgagactgcagtgagccgccatcatgccactgcattccagcatgggcagcagagtgagactgtgcctcaaaaagaaaagctacacgccgattttcaatagtgcgactgaggtcattaccccaaccctgaattgttcaagggtcaactgtacattttagtgtatgcgaaatacccaactgttttactttgggctgcataatttttttctttaaaaatttttttttcttaaaattgatggggtgcccaggctgatctcgaactcctaggctcaagggatcctcccacctttgcctcccctgtagctgagatgataggtttgtgccaccatgtccagggagctgattgattgattgattgattgattttgagatggggtctcactctgtcacccaggctggagtgcagtgttgtgatctcagctcattgcaacctctgcctcccaggctcaagcgatcctcccacctcacctcctgagtagctgggactgcaggcacaggccaccatgcctggctaattttttgtatttttaggagaaacaacatgttgcccaggaaagtttcaaactcctgggctcaagcaatctgcccaccttggcctcccaaagtgctgggattacaggagcgagccaccgcactcggccccagctgaatgatttttaaggtaccttccagaagacatgctttataattctataccatggcacacatccgacactcaatcacagtgcctcatcttgttgcacccagagcaggttcctgacccagggccttggtgtttgccatcccctctgtctaatggaccattccttagatggtcacagcccactcctttgcttaccgctcggctcaaatatcgcttcctcagagcagccttccctgattagcctatctaaaaatagcatactgtcactgtcctttagcctgccttctttttcttcatcgcatttaccactgtctgactttataggcttcccttgctcactggcaaactaggtccaccagggcagggacctcatcagaattgttcgttgctgtatccccagaatctggcatctaatagttgctcaagaccatatttattgaattaattgaatgaattgcaatttgagtttaaatatttacttctttttgcctcctcaaccagacaggaaattcatggaaggcagccaaaggccctggttgcttatttatctcctctaaagcaattagctcaattctgcatgggtgacagacattcaaccaagatttgctgaaggccttgaaacaaggataagttacacagctaaccaacatgcattctttccaggtgaatgaacacagtaatgccttgtctttaggcccacacatcacagtctacaaagtttttatttttatttttgagacaagagtctccctttgttgcccaggctggagtggagtggcatgatcttggctcactgcaacttccccctcctgggttcaggtgattctcctgcctcagcctcccaagtagctgggattacagacacacgccactacgcctggctagttttttgtacttttggtagagatggggtttcaccatgttcaccaggctggtcttgaactcctgacctcaagtgatctgctcacctcggcctcccaaagtgctgggattacaggcatgaaccactgcgcctggtcataaaggttttttgtttgtttgtctctttgtttgttttcagacagagtttccctcttgttgcccaggctggagtgcaatggcacgatctcggctcactgcaacctccgcctaccaagttcaagcaattctcctgcctcagccccctgagtagctgggattacaggcatgcaccaccatgcccagctaattttgtatttttagtagagacggggtttctccatgttggtcaggctggtctccaactcccaacctcagatgatccacccatctcggcctcccaaaatgctgggattacaggcatgagccaccgtgcccggcaccacaaagtgatttttatatttttttctatagaggtggggtcttgtcatgttgcccaagctggtctcaaactcctgagctgaagcaatctgcccactttggcctccagaagtgctgggattataggcttgagccactgcacccggcctacaatgtatttttatgtatgttaactaatttttagcattttgccaatactttagtagttcttaacctttgcctgaggaaatcagcactcaaatataacaaatgttaatttcttgcacatgctattactaattttgagtaccttgaaaaaacttagatatcaatggcatttaatgtgttctagaatgtctgaataaatattttattttatttatttttttgagacagggtttcattctgtcacccaggctacagtacagtggtgcaatgtcggctcactgcaacctctgcctcctaggttcaagtgattctcctgcctcagcctcccaagtagctgggattacaggtgtgcgcctatgaggcccagctaatttttgtgtttttagtagagatggggtttcaccatgttgtccaggctgctttcaaactcctgacctcaagtgatccatctgcctctgccttccaaagtgctgggattacaggtgtgagccaccgtgcctggtcctaaagaaatattttaagagactggaatatatacctgtatttcaacatgtacatatgcatggagagatttttggatgaatgtttaacaattttcacagtgggcatttctgttggtgggaccttgataacatctgtttttttttttttttgatggagtctcgctgtgtcacccaggctggagtatagtggtgcaatctcagctgactgcaacctctgcctcccgggttcaagtgatccttccacctcagcctccagagtagctgggactacttgtgtgcgccaccaccccggctacattttttgtatttttagtagagatggggtttcaccatgttggtcaggctggtctcaaactcctgacctcaagtgatcctcctacctcagcctcccaaagtgctgggattacaggtgtgagccaccgcgcccagccaataatgtttagtgttttgggctttccattgttcttatttgaattaaaaagaaaaatgttttcctgaccttatgtcttgagattgaatttaaaaattttattattattactattattattattatttttacaggcagggtcttgctatattgcccagactggtctcaaactccaagcctcaagccaccttccggcctaaacctcccaaagcactgggattataggtgtaatccaccatgcctctcctgaatttttttttttcaagcagggtttaagaaaatatatttaaattttttagttttatttccttttcttctcttttgagacaaaaatctcgctgtgttgcccaggctggtcttgaacttctgggctcaagtgatcttcctgcctcagcctcccaaagtactgggattacaggcatgagccactgcgcctggtcatttttatttttatttttaagacaggatctcactcaggctggagtgcagtgtcacaaacatggctcactgtagcctcgacctcctgtgctcaagccatactcccacctcagcctcccgagtagttgggaccacaggcactcgccaccaagcacagctaattttatttatttatttatttatttattgagacggagtctagctctgtcgcccaggctggagtgcagtggcacgatctcggctcactgtaacctctgcctcccaagttcaagtgattctcccacctcagcctcctgagtaactggccttagagatgtgggccaccatgcccggctaatttctttttttaagtagagatggagtttcaccatgttggccaggctggtctcaaactactgacctcaagcgatctgcctgcctcagcctcccgaattgctgggattacaggcgtgagccaccacacttggcctgaaagcatggatcttaagtacccagcatcctgagaagacagagtttacaaaagtatgtaaatcaaatgtatctctgatactttgctgaagaaagccttttacttaacatacttaggatattactatggtgtaactgatgaattagcatctgataatagtttggatatctgtctcctccaaatttcatgttgaatatttttttcttttttattaccttgatcctacgttaaaggaaaaggcccagctcatttttaaattttttgtagagacagaggtctcaccatgttgcctaggctgttctcaaactcctggcttcaagtaatcctctcacctcagtcttccaaagtgctgggattacaggcatgagccactgcatcctgctgagagagagagagagatagatatatatatatataattttttttttttgagacagagtctcactgtgtcacctaggctggagtgcaatgacgcgatctcggcgcaccaaaacctctgcctccaaggttcaaatgattctcctgcctcagccttccaagtagctgggattacaggcatgtgccaccacacccggctaattttttgtatttttagtagagacggggtttcaccacattggccaggctggtctcgggaactcctgagctcatgatctgcccgcgtcagcctcccaaaatgttgggattacaggtgtgagtcaccacgcccggccagagattcaatttttaaaacaaatatgaggtcagcaaacaaaatctatttctatacaatgttttatttttgtcagtgtaaataacacaaaaaatacggctacttattttcctggctatgtaataattagtacatagcaaatttcattcagggaaaacttttttttttttttttttttgagatggagtctcgctctgtcacccaggctggagtgcaatggcgagatctcggctcaccacaacctccacctcctgggttcatgtgattctcctgcctcaacctcctaagtagctgggattacaggcatgcgccaccacacccggctaattttgtatttttagtagagatggggtttttccgtgttggtcaggctggtctcgaactcccgacctcaggtgatctgcctgccttgacttcccaaaacgctgggattacaagtgtgagcaaccgcccccggacagagaaaacttttaatactgatttctagtaaagcaacagcaacaatcaaattgaatgaatcaaaattccgaagggttttttttgtttgtttttggtggacaggaagtaggatttactggggagtattaagagggggcagcacagtggaagccctcacgagggcagggcacgccacttgtccagagggccatgatggggatgtacttgaccccacagtcatctgcgatgagccgcttttcagccaccatgtcttcaaattcatccgcagtgaacttggtgaagccccacttctttgaaatgtggatcttctggcagccagggaacttgaacttggccctgagcagggattcaatcacatgctccttattctgcagcttgttgcagatggacatgataacttggccaatgtgaaccctggccacagtgccctggagcttttcaaaggcacctcgaatatctgcctggagcctacattggcgtagtgcaaggtcaaagacatgaacatacatctgaaaggcctgtctccatggtcccttagagcagcccatacaagaaacaggctgcataaactaccaaggaagctgttgtttgcagctgaagggtctttgtgtgttttccgtatttctggtcgtgctatttattctcttaccaaaaaaaaaaaaaaaagtaaggtcaggcgtggtggctcacccccttgtaatcccagcagttttggagtctgaggtaggaggatcgcttaagtccaggagttccagaccagcctgggcagcgcagagcaacttcgtctctatgccatgttgacgcgtgcctatagtcctagctactcggaggctggggcaagaggatcgcttgaacccaagaggccgagcctgcagtgagctgtgaatgagtcactgaactccagatgacagagcaagagttagtctcgaaagaaagaaaaaggtagagcgacacttagttctttgatagttttccactatttgtcataaaaactttccaggatattgagctcccaaaatggaaggccaatatcaggcatcagggacttgttctggacgttggaccaaccttaaagggcccacatagaagctgttcacttactttcttttagtctcttgatttaaaatacttaacattcccctttccttggctttttaaccactgagatttgaaagacatgcaaataacgacctagtggacaatctttgctgatgctaaatcttcattttaggattaaaaggttttgggttttcttaaaatttaatgctgaactcagaagagctttctaaggctgttggtgcaccttagggcaggagagcgtctttgctacgccgcgcaggagtgtgtctgcttctctgtgcatctacacgtgtttgcgtgtccctgtaaagtgggttgagtgtgcggctgcggctttccgcccttggctcacactctcagtcttagtggtctcccccagggctatgcatggggtacaggtttctgtggcctcaggccggggtgaggggtcccccaccccggccagggcgcagcagggcggggcacacgtagccgtgcagggtctcgcgcagcccgcgtcaggaccccggggcacacgctcgggcagggggcgtgtccccacgccaccagaaaaagtgttataggctgtttttttttttttttttttttttaaaaagaaagtgttttagaaagcaggcagaagccaagacgtcaggaagggttgcgagggcccgggatccggcggccacagggatgggaggggcgaggagcgaggggcggagtggcacctcccacaacgcgctccctgcggggcgggcggcaacctccatgcggcctcgtccacgctcagcaccggggaagccgaggcggagaagccgcgcgcgcctcagaagctcccggacgcccaggtacgtgggagcactccacagatggcgcaagtacggttgggccaggcggttgcggccccgtcgcgccgcggcctctgtgacgcacggcgaggcctcccgggctgctgcgcggcgcagcgggggcggggcgagcgcgtgagggcggggcggtggggggggggggcggagcgagaggggcggagccggcagaggccccgccccggggccggaggagcgaggacgctacggagcaggcgcgtctcgctgccgccgctgccgccgccgccgctcgctcttctgtggagccgccgccgccgccgccgccatttgcacggggaccccagtgacaggggctcggcggaggggcggaggggcggagggagggggggagggcccgcggagcccccgagggcgggagcgacgccgccggcgccggccgggctccctgcgcgaccgcgccgcccgcggcgggccccgagcagcagcagcagcagcagcggcagcagcggcagcagcagcagcagccgaggccgggcgtgcgcctgaggcggcggcggcggcggccctgcgggcggccgggaggggcgggggcagcggccgccgccgtttgatggatccgaggatcgcctggtttcagccagagcagctcggaccgtccaacagtctgtggatgcagatctgggagacgacccaggggctgaggaacctctacttcaaccaccactgtcacagcagcggcggcgcgagcggcggcggcggcagcagcagcagcagcagcacggccaccggcgggagcggcagcagcaccggcagccccggcggcgcggcctcggccccggccccggccccggccggcatgtatcgctccggggagcgcctgctgggcagccacgcgctgcccgcggagcagcgggacttcctgcccctagagacgaccaacaacaacaacaaccaccaccagcccggggcctgggcccgccgggcgggctcctcggcgtcctcgcctccctcggcgtcctcgtccccgcacccttcggccgccgtccccgccgccgatccagccgattcggcctcgggcagcagcaacaagaggaagcgcgacaacaaggccagcacgtatggactcaactacagcctgctgcagcccagcggagggcgggccgcggggggcggccgagcagacggcggcggggtcgtgtacagcgggaccccgtggaaacggaggaactacaaccagggagtcgtggggtgagtgctggctctgcggcccgatggcctggccggtgcgaatgcgcagccgggcacacgcccacagaggggggttgtgagggtctaggagcggccacccccacggcctgccttcgctgctgttgcacgggggtgctgctggccatccccaaccccccagtcgttcacacctttccccaagcctccttagccgtccacaccctccgtctcctgtcctcccttagtcgtccacaccttcctcccctccctcttaaccgtccacaccttccccaggcccccccctttatccattcactctcctcccatcccccttagttaaacacatctacccttgaccaccaccccgcctccagccctccacacctttttccccatcatcacaactcaagatgagaccgcttagcacgggcctatcattcattccctgagaacattggtgtgtgagtgttttttgatggtgcaggacccggaggtgctttccttgccaagaatagaaacatccagaatgctcctccccatcccccaatcccagacagcaattatgtcagccctgtaaggcattgcctgctcttgaccctttggcccatctttttatttttaaaaaattcccatgtcacagatgccctgtctatgcagagggtggcgtgggatgggtgaccactaagtttaggctggtgaaggtggtgagcccttctgaggccctgatagaactttccaggagttcatggtccgcggctccagcttctcactgtaaagttgtcatcctggcagaggcagccaatgcttttcattctagggggtagagatttatgctaatgagtgaatattgcaccactagtgactttctgtttaaagttcagctcttagaaaatggaatcttacctgacccctagtgaattatgtacataagcagggaatgtttccaactagatctcccttcagaagagtccctgtgctggaataggtcactgaatcttatttgttttgtaaaacaaagcttttgggtctcgtgggtgtgtgtgtgtgtgtgtgtgtgtgtgtgtgtgtgtgtgtagcttgagtatggagaaccggctttcaaattgcttttcatttttcaggttgtgttttacattgagggctttagcatgcaaatgaaattaccaattagtaatcccatgtgaaccttttcctggatttattcattcagatctgccctgctttggctgagagagagagttctgtgtacctttttgaaggtctggataaaatgagttggtgggttccatctgcttccagtgggctggtgtctgctctatgctactattacaactcctaccttttgtggaaaatgcagtcaagcgttctaggactggtgctgtggtacatgtcaaacctgccctcacattccagaaagggaacccttttagggttgagtcctctgttgctaagcttcaagggtgctctccatggtcatcacgttttattaaaggcttgtggttccatcctgttagcatttccaagtctacgcgtaaacctgtggtttagtgacaagcaaattgatgttgagggtttctggtagtttcatttcacaggagtaagctccagttaggtaatcactgtcaacgaaaaccttgaagttccttaattgcattttactgaagcctctttgcatgtgtctagcaaaagatataagtccaagatgcttattttttttttgataaattagaaattgtcctctcctctacttgctatttaatgcagaagatactctaaaaggttcatatttatacttagaagcaagatgttcttgttcctgattcaaatatattgccctcaaagggattaggagaggaattttcatttcccggagggattactgtttaaaaactggttgtaaacctctttaaaaactgcttatcacttcaccagattttccattcttttgcctcctcccttagaggatgtcagcagttaattttttttttaaattaaaaaaagttcaattctgagacctcctagtttcaaaaaatacattaaacaattcccaagagtgttaagagtgtctgggtgcttagaaattcttgctttgattcatgtattctgattttttttttttttttgagacggagtttcgctcttgttgcccaggctggagtgcagtggctcgatctcagctcaccgcaacctctgcctcccaggttcaagcgattctgctgcctcagcctcccgagtagctgggattacaggcgcttgccaccacgcctggctaattttttatttttagtagagacggggtttcttcatgttggtcaggctggtctcgaactcctgacctcaggtgatctgcccgtcttggcctcccaaaggactgggattacaggcatgagccaccgtgcccggcctcattatcctgatttcttttttttcttttgagactgggtctcactctgctgcctaggctggagtggagtgacgtgatcatagctcactgtatcctctaactcttgggctcaagtgatcctcctgccttagcttcctggagtagctgggactacaggcacatgtcaccacacctgcctaatttttttatttttactttttgtagagatggggcctccatttgttgcctaggctggtcttcaaccggcctcaagcagtcctcccaccttggcctcacagagtgctgggattataggcatgagccaccattctcgccagtatccttatttcttaactttagaaagtttttctatttttaatataggtatttaaaaaaatctgaattcagagtgcacctcgatgttatgctgttctgagattaaatatactaaaactgttaccattgttttctgaattcttaagatgtgactgatagttagctaataggttaacacattgtggtggttcttggcctctgaactgatagtccagatggggagaggagaccagaaagcatgtgaaaatggactagaaccatgggacagctatatagtctctcgcagctgtcttttgtgttctctgcttccaccaaattggttgatttatttagaatgctgacctcttgcattgcctaagtccttgatgtttttggtttctcctctgaactctcaaaggtactcacttcatgctcttggtatagcccacttatgtttaactttccttttattatgtgttccctcttacacatgacatggacatttctttaatatgtagagtaagatattggatttcatcctaaagtcttcaaaataaaactcttgagctcatcatctcagacttcttcatgtacccacagaccagggattttgtttgctttttaaaacatttttttattttgtgttttattatttttaaattttaatttaattttatggagacagggtctcgctctgttgcccaggctggagtgcagtggtgtgatctcggctcactgcagcctttgcctgggctcaagccatccacatgccttggcctcccagtgtgctgggattacaggtgtgagccactgtgcctggcctaaatttatttttttaattttttttgagacagggtcttgctctgtcgctcaggctggagtgcagtgtcataatcatgggtcacagcagccttggcctcccaggctgaagtgaacttcccacctcagcctcctgagtagttgggactacaggcgagtgccaccatgcctggctcattttggttttttttgtaaagatggggtcttgtcatgttgcccatgaaggtctccaactcctggtccaagtgatcctcccgcctccgcctagcaaaatgttgggattacaggtgtgagccaccatgcctggccttatttatttatttaattatgaatgaatgaatgaattaatgagagggagtcttgctctcttgcccaggctggagtgtggtggcacaatcttggcccactgcaacctccgtctcccaggttcgagcaattctcctgcctcagcctcccgagtaactgggattacaggcgcccgccaccatgcccaggtaatttttgtatttttagtagagatggggtctcaccatgttggccagactggtttcgaacttctgacctcaagtgatctgcccaccttggcttcccaaagtgtcaggattacaggcatgagccaccatgcctggcctggccttttatgttttaagttgcttccactgattctcttgggctttgctcccctccagaactggccatggtttaggatgctgtccacctgctgctgcttgtccatgaaaacgagccataaacccttttcttttgaaagacttaattgtttatcactatggagaaagaggggatggcaagaagtagcaaatacagggaatttgcagaacttggtcttgagccctgggtccagaaacttcttctggaaggtgcttggtgtttgtccaagctcatgataggtttctgttggctgtactgccagatctgtagatgcttttttaaggcttggatgacttgttcaaaacaatgttttggagtacaaatttggctgtggggacatcaagaccttgttgggaaacttgggtttaaggtacaatttcttaaactaggatggtgggaatggggatgtgaagggagaatgaatgtgagaggtattacagggtaaggatggagatgattcagattccttaagtggatttaataatcacactgtagctttgaacttgagtgactggggaaatatttgtggtgtttttggaaataagggccagaaggactattggtttgggtaagaagatagtagggggatgtataggtggacctgctagtggggagctgagatttggagggctgagatgtagtgctcttcactgccgtagggcagtatcctcttgtatgtgccatcctctagtgcccattgttcatcatgtcatagtaagcccaagatgttcatgccttttttcagcactgcattagggcttatatctgcttctctttctctctctctctcgctctcgctccctccctctctctctctttctgttttttttttttttttagacggagtttcacttgtgttgcccaggttggagtgcagtggcgcgatcttggctcattgcaacctctgactcccgggttcaagcaattctcctgcctcagcctcccaagtagctgggattacaggcatgtgccaccatgcctaattttgtatctttagtagagatggggtttctccatgttggtcaggctggtgtcaaactcccaacatcaggtgatctacctgcctcggccgcccaaagtgctgggattacaggcatgagccaccgcgcccggcctctctctgcttatttctacacagtgttaccaatgagattggtgttactgctgggctccaaagcaatcagacagattaaagtagattgaatatgaaagaatttagaggcctttttccaagtgatttgtgctctatttaatttctgtgcatttgcagatatagcccacagtaattcttagtgaactagaaccttcaggttattgaattttactgatttgggtactgacatgcgcttttaagaagacattaggttttctatagtgtagattgtacactaacaatataattcatatttaagaatgtctcaaaatttagtatactgtgttcaactaacttaactttctttgttttttttgttttgttttgtttttgttttttgagacggagtcttgctatgccacccaggctggagtgcagtggcgtgatcttggcttactgcaacttcaacactcctgggttcaagtgattttcctgcctcagcctcctgagtagctgggattacaggcacccgccaccacaccggctaatttttgtatttttagtagagacggggtttcgccgtgttggccaggctggtcttggactcctgactcaaatgatctgcctgccttggcctcccacagtgctaggattacagacatgagccactgcgcccggccgctaacttaactttcattccacaacttccatcttttatccaaaatctgtgatcattgaatactgtcaccattaatcattggcatttcagtgtttggactttttttttcccccttcgtctttgtggactcttttttaacactcataaagttttaactattgaaaagcaaaggaaacggtgagtgactttttggagtctgtctacccagtggtcacacaaaaggcttactacattacaggaaagataggatgggaaagggatactagaaaattctaagtcaggaacgggggtgtgtattagaaaaattctgatcctggcatgccagatggccttacatctcaatttcttccgtgaaattcctgccaacaaatcatagtgttagaagtacagaagggtccatgggaacagaatttaagggctccgttggtgatacggaactgatcagatggttctcacttgttctcagataacctgtatactgaatatcacaggaagggtatagacgtcatggcagtggttagatattcttgcacctgctgaagctgagaaaattaaagtaattttttttcctgtggaaagtagaaaatcaagcttttgtatgatttcacacagctttctattctctcttttgttgactctgttaagagtaacatttagtggtggaaactatttcaggatcacacccacaacactagagactgtattaatcacttacacacacataggtatagagtaatcttgaaggggctgtaggccaaagataatgcttttttgaagaattagagactagttaccagcacctggtatttgctgtttcctacagagctgactggacagcctagagtctgctgaggaattcagaggatggccagtagaatgttctttccaccccagaatatttggtagggactcagctgctgtggaatgccaaaaaggctttgagtttgtttcactattcttaagattacacgtaattgtttttttgtaagagattatatatattcaagttgaggatggctttgagttagactttccttaatttggaatcacacagcagatgatacatttatttccatctgataagttacttgatgatgtaaaaagacatttgagttaaagatttttgggaaaaaagctgaatgttgagccatttatgttgtgtactggttccctattcacttggacaattttaagtcttaaaacaatcttaaccatgtgcacaagagatttcacatagtatttggtaattaaattaaggaattctagctcaagtcatgctttttgctgaaatagttgtatatatttagtgcggaaacctgtgttttcaaattaatgtaataaaagtttcaataaaatggaagcctttattaccgtgtttcaaatgctatgctaaaccttttccatttgttattatattaacctcctcatacatagccctactaatttttttactttctattttgaaataattacagatttataggaagttgtgaaaaatagtacagagcccatgttcccttcaccaagtttcacctaatggtagtagctcacataacgataatttaatgtcaagaaccaggaaattgtcatcgttgcaatccataagccttttttagatttcaccagtttcacatgtatttgtgtgtgtgtgtatatatataattgtatgcaattttatcatgtgtagatctggatagccactgtaacagtctatagttctatatacagagctactccatcacctcagggctccctatgctaccactttatagccgcacgcacccttccagcaaccactaatctgtttgcatctctgtaattttgccattttgagaatgttatataaatggaatcatacagaatgtaactttggctttttttcttttaccatacttcctttgagagccatccaaattgctgcatgtatcagtagttcatttctttttactattgagtagtagtccatagtatggctgaaccacacaatttgtttaaccatttacttattgaaggacataccagaagggtggtttccagttttttggctattgcaaataaagctgctataaacattcatgtatataaatatttttatgtgaatataaagttttcattttgggggaataaatgcccaaatgtttggattgtatggtaagtgcatgtttggtttttagagaaactgctgaactatttattttctagaatgactatatcctcttatattcctatcaacaatatatgagatatccagtttctctgcatccttgctagcatttagtgttaccacttttttatttgagcggttctaatatgtgtagtgatagcctgttttgccttatattaatcaataaaaatagcctcatctaatcttaactttttttattttaaaacatcttggcagtattgaactttctcaatgaaaaatctctaaaattgtgacttgaaaggctttaattttccagtttttctttggttttactcttagcagtaacattttaacttttttttgtctttgaagtaattttcagtgtttcctttacatgttgctttttcttagaaactagttactagcatgaagtagatctttagcctcgttttctaaaaacataaaaaagtaaaactgtggggtttatttcaaaattgagagtcctgtcttttcatatgaggatattttatagtctgttggcttggctatattttagggagtaaacctgtggttagtggtttgttgttggtggtggtaaagttttcttacagtatttttatacctgaataatacctttagactctatagaatagatacttgatcttcaaatctatcctagaataaattgttttatctaaacagctttgtgacctgagaattgggacttagtcccttagttttcccttactggccctttgtagtcactgttttgattttgtgaaagtaacttaactcttagcactgtcaggtattgtacattcctgccaaagcaagaataagaatacataggattgtgttttaattctataattaggtgacttttggctaatttccaggaacttggacttaataaagtactagtgataagtttggaaattttagtgtccttgttctttgaagttattcaccctttactttcttgtttgtttggggtgtttatactactgtccctaaatatagctgaaataaaggaagaaaaataacccctgtaatatcactaccaggatataatttcttttttttttttttttttgagatggagtctcgctctgtcgcccaccatctcggctcactgcaagctctgcctcctgggttcacgccattctcctgcctcatcctcccgagtagctgggactacaggcgcccgccaccacacccggcttattttttgtatttttagtagagacggggtttcactgtgttagccaggatggtcttgatctcctgatcttgtgatccacctgcctcggcctcccaaagtactgggattacaggcatgagccaccgcgcccggcctgatataatttctgttaacagtttgatgtaaatattttttgactttttagtgtttttatatatatatatattttatgtttttcttttatcaatacgcactcttactgtgggaataattttaatgtttttaaagagttgggttttatttgtttattttattttatagaaatggggtctcgccgggtgcgatggctcacgcctgtaatcccagtactttgggaggccaaggcaggagcatcacctgaggtcgggagttcgagaccagcctgaccaacatggataaaccgcctctctactaaaaatacaaaattagccgggcgtggtggcacgtgcctgtaattccagctacttgggaggctgaggcaggagaatcacttgaacccggccggtggaggttgcagtgagcaaagattgtgccattgcactccatcctgggcagcaagagtgaaacttcatctcaaaaaaaataaaaaataaaaaagaaagaaagaaagaaatgggatctcaccattttggctggttttgaacttgtggtctcaagcagtcttcctacctcagcatcccaaagtattgggattacaggtgtgagcccatcctgtttgttgttgttcttttgttgttgttgtttttagatgaagtctccctctgtcacccaggctggagtgcagtggcgctatcttggctcactgcaagccccgccacccaagttcaagcaattttctgcctcagcctcccgagtagctgggattacaggcgcccaccaccatacctggctaatttttgtatttttagtggagacgaggtttcaccatattggccaggctagtcttgagctcctgacctcgtgatccacctgcctcggcctcccaaagtgctgggattacaggtgtgagccactgcgcctggcctgttgttgtttaaataaaagaaatttattctcttacagtcgaggccagaacttagaactggttttcaatctaaattttttttcttctttgggagaagggcatcagaatattgtggatatacttttttgacttaaaaaaaaaggttttactgggctgggcatggtggctcacctgggattaactgcctgtaaccttggcactttgggaggctgaggcaggtggatcgcttgagtccaggagttcaagagcagcttgggtgacatggtgaaactccgtctctaccaaaaaaaaaaaattagccaggcatggtgatggcgtgcccttgaagtcccagctacttgggaggcttagctgggaggatcgcttgagaccaagaggcagaggttgcagtgagctaagttcatgccactgcactccagcctgggtgacagagcgagacctcgtctgaaaaatttttttttttttttactaatatgacaaacatcttttcatttcaaatatatttctataccatttttaatatctcattgcctttagaatgaccttgtattcatagtacatatgtatgtgatattccatttatttattttttttcttttgtctttttttggttatattccattgatttaatgtaccttaatttatcttaccaatttcttgttgaccattttgtttccagtcttttgtttttttaccagacatggattaagctgagcctttgccccagacgacattatttcttttttatcagcaaaatatgcgtgtaatgaaattagaattaaaaggcaaaaaaggttatcctttatttttctacttatttttattgagatagtaattcacataccataaatttaacccttttaaagtgtacagttcagtggttttcatatattagaaggttgtacaaccatcgcaactaattccagaacattttcatcaccccagaaagaaactctgaacccattatcactccccactccctcacacaccctaaccctggcagtcacatatagactctctgtctctgtggatttgtttactctggacctttcatataagtggaatcataacagtttgtggccttttgtgcttggcttctcaaacttatctgtttccaaaggttatctgtgtcgtagcatgtgtcagtacttcattcctttttatggctgaatattttattgcatgtatatgccacattttgtttatccattcacctgtagaaggacatttaggttgtttccattttttggctgttatgaatattactgctgtagacgttcatgtacaagtttttatgtgaacgtgttttcatttttcttgggtatatacttaagtgaggaattcctgggtcttaagttaactctctgtttaacattttgaggaactgccaaattattttttaaagtggctgtgacattttatattctaccagcagtgaatgaaatttccaatttctccacatacttgacagcacttttttttttttttttttttgaggtgaagtcttgctttattgcccaggctggagtgcagtagcatgatcttggctcactgcaacctccacctcccaggttcaagcaattcttgtatctctcagcctcccgagtagctgggattacaggcgcatgtcaccatgcctggctaatttttgtattttttatagagacagggttttgccatgttggtcaggctggtcttgaactcctgatttcaagtgatccacctgccttagcctcccagagttctgggattacaggcgtgagccactgcacccagtctgcactttctttattatctgtcttctttattatagccaatctagtgggtatgaagtaagtgtgtcatttgtgattttgattgttagtggtgactaaaaatgttgaatatctttacatgagcttgttggccatgtgcacatctttgttggagaaatatctattcaaatcttttgactattttaaaattgggttatttatctttttattgttgagctataggagttctttattttattttactgagacagggtcttgctctgtcacctaggctggagtgtagtgatgccatcttgactcactgcaacctctgcccccaccccaggctcaagtgatcctcccacctcagtcagcatcccacagctgggaccacaggcgcatgccaccatgcctggctaattttttttttttttttttttttgtattttagtatagacagagtctcaccttattgcccaggctggtctcaaactcctgagctgaagcaatccgcccatctcagcttcccaaagtgctggaattagaggcatgagccactgtgcctggcctattttattttaaagatgaggcctcactttgtcacccaggttggagtgcagtggcgtgatcatagttcactgccattttgccctcctgggctcaaacagtactcacgactcatcttcctgagtagctaggactgcaggcatgtcgctagcatgcccagctaaaacagttctttatattctagatcggggtgtccaatcttttgacttccctgggccacattagaagaagaagaattgtcttgggccacacataaaatacactaacagtaatgacagctgatgagctaaaaaaagaattaccaaaacatctcataatgttttaagaaagtttacaagtttatgttgggccacattcaaagccatcgtgggcctctggccgtgggttggatgagcttgttctaaatgctagacccttatcagatggatggtttgtagatatttatcgcatgctgtgggttttttttttttactttcttttaggtttttttttttcttaaataattaaactgattaaaagctttaatcttttcattttcttgataatgtcttttaaagcacaaagttttgtttcaatgatgtctaatttgtctatttttttttctttggttgcttgtcatacgtaagaaactgttgctaaatccagaatgctgaagatttacttgtgaactttgtttccttctatgagttttatagttttagctcttgtatttaggtctttgatacattttgaggtttttttgttgttgttgagacagtcttgctctgtcgcccaggctggagtgcagtggtgtgatcttggcttactgcaccctctgcctcctcggttcaagcaattctcatgcttcagcacccgagtagctcggattacaggcgtgcaccaccaagcctggctaatttttgtatttttagtaaagagggggcttcaccatgtttgtcaggttggtcttgaactcctgggctcaagcaatcctctcatctcggcctccccaagtgctgggattacaggcatgagccaccacgcccagcctgttttgagttcatttttaaaatatggtgtgaggtagaggtcccatttcattcctttgcctgtgggtatccagttgtcccagaaccatttgttgaaatgactcttgtttcctcattgagcaatgtcgtgagaccctatctccataaaaaataattaaaaaaaaaaaagaatgcagaaggaaacagttttgccaattttgtagtatttactgacaatttgcatatgtctttacattctttagctatttatttttcttttgaattactgcctttgttcatttttcttttggagttgtttgtctttttcttattaatttgtaagagattttgcaaatatatacaatttcttttctcttttttttgagatggagttttgctcttcttgcccaggctggagtgcagtggcatgatcttggcttactgcagcctctgcctcctggtttcaagagattcttctgcctcagcttcctgagtagctgggattacaggtgcccaccaccacacccagctaattttttttttttttttttgtatttttagtagagactcggtttcatcatgttggccagactggtctcaaactcctcacctcagttgatccacccaccttggcctcccaaagtgctgggattacagttgtgagccaccgtgcctggacctcccacattattttgaaacaaattccatatcacataatttcttttttttgagacagagtctcgctctgtcacccaggctggaatgctgtggcgtgacctgtgcttactgtaccttctgcctcctaggttcaagcgattctcctgcctcagtctcctgagtagctgggattacaggcacgcaccaccacacctggctagtttttgtatttttagtagagatggggtttcaacatgttggccaggctggtcttgaactcctggcctcaggtggtccgtccacttcggcctcccaaagtgctgggattacaggcttgagccactgcacccagccaatatcatataatttcatataaatagttctttgtgtatctttagataaggacttaaaagaaggcataatcgtaacaccattattaatacctaaaagaagtgagcaataaataattcatttgccgtatcaaatatccaatgttcatatttcctccattgtcccataataatttttaaaagtttgctcaaatcaaaatccaaacaagattatttcaaagcattgtttgaggtacattttaaatcttaatttatagatttctctgctgtctcttttcccccatatttatttgttgaagaaaccaagcgttgtttcctgtggactttcctactctctggattttgctggttatattcctctggtatcagtttactatgatccctttttcccctgtattttctgtaaatttgtaactagatctagagatttgtttagattttgtgggttttttttttttttttttttttttttgcaaaaatgcatcataaatggtggtgtgtacatctctcagaagacacatatcttaatgtctttttgtggtattagttattaatgattactgcctatatttattaattcattatttggattgtaagtttatgatagtctcttgatgctttttctgttgttagctggaatgcttctaaaaggagaaggctttcctcttcaagctacttggttgtcttgagggtttgcttcttatagggaaagcaggctaagggtgaaaaaggaaatagtttctaactgggtctgttaatgagctgtcaccccaggcaaagagaagcaaggcaggtcacaggaaagtgaagtgggcttgggatgattggtgccccatgcgtgcatgcatgaagggaagttaatcctccctgtagtgaactctactgggcttttggtcagtagccaagactgtcaaggaagacctttgtcagaagccatacctggcctttgcttttagctgttggtagctgaaggaaaccagaacagacctatgacctgtgaacttctgctcagtagacaaagttctctcagcctaaattcagtaagcaggagtaagatgcttgctttcccttgaagtgaaacgtgaattatatgtttcttcaacttgtgctaatattctttttttttttgagatggagtctcacactgtctcccaggctggagtgcagtggtgcaatctccgctcactgcaacctcagcctcccgagtagctgggattacaggcgcctgccaccacgcctggctaattttttgtatttttagcagagatggggtttcactatgttggccaggctggacttgaactcctgacctcacgatctgcctgcctcggtctcccaaagtgctgggattacaggcgtgagccaccacacctgggcaacttgtgctaatattcttaaccttcatgtgaatcattcctgccctcaggctagcataacccatacagccttccttataggaagatttcctactgggagtgaatttgtccagtgattcccccaagatatcccccaatcaaatattttaaaagtcatcatttacatgtaaaaactatgtaacaagcatggtagcagcagcgttaaagaaatggcagtatggcccctgtaagggaaggctccagaagatgagccgcactcagcctctaggtcacagctaccttaggagtttgcagttgttcctggggaagtcagtagacaaagctatctctcaggcctgggcaagatagggattttttttttttctttgagatggagtctcaccctgtcatccaggctggagtgcagcagcatgatctcggttcaccacaacctccacctcctgggttcaagtgattttactgcctcagcctcctgagtagctgggactacaggtgcgggccatcatgcctggctcatttttgtatttttagtagagatggggtttcaccatgttggctaggctagtctcaaactcctgacctcaggtgatccacctgcctcccagagtgctgggattataggcatgagccactgtgcccagtgtttttttttttttaattgtagtgacaggatctcactttgtttcctgggctattcccaaactccaggcctcaagccgtcctcctaccttagcctcccagagtgctggggttacaggtttgacccactgtgcctagtctcagaattcatgtttttaaaagtcactctgtgccaggctcatgcctgtaatcctaatactttgggaggctgaggcaggagggttgcttgagcccaggagtttgagaccagcctggaaaccatagcaaaatcctaactctacaaaaaatacaaaaaatagccaggtgtggtggcatgcacctgtagtcccggttacttgggaggctgaagtgcaaggatcgcttgagcctaggaagttgaggctgcagtgagctgtgatcatgccactgcacaacagcctgggcaacagagtgagaagtaactctggctgtggtggggaaagtggattagtggagaatggaagctgggaaacatggtggttcttgctaagtcagtatcaagggatcacagatgagggggctatttcgtcctaataagggccttggtctcccagatagtcatggatttttctatttagaagctccttctcagtttttcttgcccaaggcatatacggttgatatttgtacaacacaggctggatctgtatgggtccacttatatgtggattttttttcaaccaaacttggattaaaaatatagttgtaggccaggcacagtgacttatgcctgtaagcctagcactttgggagcccaaggcaggcggatcagctgaggtcaggagtttgagaccagcctggccaatgtggtgaaaccatgtgcctactaaaaatacaaaaaatagctgggtgtggtggtgtgcacttgtaatcccagctactcaggaggctgaagccagagaattgcttgaacccgggaggtggaggttgcagtgagctaacgcagcagaggttgcagtgagctaacgcagcagaggttgcagtgagccaacggggtggaggttgcagtgagccaagattgcaccaccacactctagcctgtgtgacagagcaagactctgtctcaaaaataaataaataaaaatacagtgtaggccaggtatagtggctcatgcctataatcccagaactttgagaggccaaggcaggcagatcagttgaagccaggagtttgagaccaacctggctaacatggtagaaccccacctctactaaacagaagtacagaaattaaccaggcataggtggtgcatgcctgtaatcccagctgcttgctaaactgaggcaggagaattgggaggcagaggttgcagtgagctacgattgtgccactggactccagactgggtgacagagcgagactctgtctccaagagaaaaaaaaaaattgtacttacaggacatgaaacccacctgtacggtgtgctgactgggagactggagtatgcatagttcttggtaaacaaggggattcctgaaaccaatcccctgagtatatggagggttgactatatattttaatagaatttattacttttttttttttttttagcagttttaggtttatggaaaaattgagcaggagtacatagtttctctatctccctcacatttccccattactagcatcttgaaatagtgtggtacatttgttacaactgaagagccaaatattgatacattactgttaactaaggtccgtaatttactttagagttcactcttggtgttgcagtttctatgagtgttggcaaatatatcatgacatgtatctagcattatagtatcatattgagtagtttcactgccctaaaaatcccctttgttccaccttttcatccctccatctacctgaacccctgataaccactgatccttttacagtctctatagttttaccttttacagaatgtcatatagttggaatcatacagattggcttctttccatgttccttcctggcttgatagctcttttcttttttttgagatggagtctcgctctcgcccaggctggagtgcagtggcgcaatcttggctcactgcaaactctccgcctcctgggttcaagcaattctcctgtctcagcctcccaagtagcttggactacaggcgcatacctcccctgcctggctaatgtttgtatttttggtaaaggtggggttttaccatattggtcaggctggtctcaaacacctgtcctcaggtgatccacccacctcggcctcccaaagtgctgggattacaggcgtgagccaccctgccctgccagctcttttttttgtactgctgaataatactccattgtataggtgtatgagtttatctattcaccttctgaaggacattttggttgctcctaagttttggcaattatgcatgaagttactataaacatctgtgtgtaggtttttgtgtggtcatgtttttagctcatttggataaataccaaggagcacgattgttggatcgtatggtaagagtatgtttagttttgtaagaaactgccaaactgtctttcagggtgactgtaccattttgcattcccaccagcaatgaatcaagttcctgtcgctccacatcctcgttagcatttggtgttgtcagtgttttggcttttcaccattctaatagatatgtagtgatatcttgtcttactttgcagttctctaatgacgtatgatgttgagcatcttttcatctgcttatttgttgttgttgttgttgtgttgttcattgaaatggaatctcgctctattgcccaggctggagtgcaatggtacaatcttggctcactgcaacctctgcctcctgggttcaagtgattctcctgcctcagctccccaggtagctgggattacaggcgcccgccaccatgcccggctagtttttgtatttttagtagagacaggatttcaccatgttggccaggctggtcttgaactcctgaccttaggtgatctgcccgcctcggcctcccaaagtgctgggattacaggcgtgagccactgcgcctggctttcatctgcttatttgatatgtgtatatgttatttggcaaagtatctgttctgatcttttgcccattttttaatcagattgttcttttattgcttctggggttctttttgtttgctttttttgagacagagtcttgctctgtcgcccagtctggaatgcagtggcatgatctcagctcactgcgacctctgcttcctgggttcaagtgattcttgtgccttagcctcccaaatagctgggattacaagcatgtgccactgcacctggctaatttttgtatttatagtagggacagggttttgccatgttggccaggctggtcttggactcctggtcttcagtgatccacccacctttgcctcccaaagtaatgagattacaggcgtgagccaccatgcccggcttattgttaagttttaagagttctttgtatatgtgtattttttgattcttttaaaattaatacttaataaaataattgtacatatttatgggatgcatgtgatattttgatacatgcatacaatgtggatcaaatcaaggtaattagagtattacctcaaacatttgtcatttctttatgttgggaacatttcaaaatgtctagctattttgaaatatacaataaattattatctataagtcacctcattgtgctgtcaaacattagaacttattctttctacctggctttattttttttaccccttaaccaaccattcttcatcagctccccgtctcccctactctttttttttttttttttttttgatacggagtcgctctgttacccaggctagagtacagtggcacaatctcgactcactgcagcttccgcctcccaggtttaagcaattctctgcctcagcctcccgagtagctgggattacaggcgaatgctaccacacccgactaatttttatatttttagtagagatggggtttcaccatcttagccagactggtcttgaactcttgacctcctgatccacccgcctcagcctcccaaagtgccgggattacaggggtgagccaccatgcctggcccctcttactcttttcttagcctctggtatctatcattctactctctacttctatgagatcaacttttttttagctcccacatatgagtaagaacatgtaatatttctctttctgggtctggcttctttgtatattttggataataagtcttttattagatacgtgttttgcaaatattttttccgagtccgtgacttatcttttcattctcttaaatagtgtcttttgcagagcacacattatacattttagtgcagtccagtttaccaattctttctttgatggattttgcttttggtattgtgtctagaaagtcttcgccaaaccacagtcatctagagttccccttatattatcttacaggagttttatagtttttgttttacatttaggtctgtgatctattttaagttaatttttatgtgaaagatataagatctatgtctggattctctctttttttgagatggagtctcgctttgtcgccaggctgaagtgcagtggcgcgatctcggctcactgcaacctctgactccctggttcaagggattctcctgcctcagcctcccgagtagcacatgacaccacgcccagctaatttttgtattttgagtagagacggggttgcaccatgttggccaggatggtcttgatctcttgacctcgtgatccgcccgcctcagcctcccaaagtgctgagattacaggcatgagccaccacgtccggccagtttttttgttttatttatttatttatttgaaacagggtcttgttctgttgcccaggctgcagtatagtgacaccatcaaggcttcgttgcagccttgacctcctagggtcaagttatcttcttgcttcagcctcctgagtagctgggactacaggtgagcaccactctgaccaggtactttttaaatttattttagagacagggttttaccatgttgcccaggctggtcttgaactcctgggctgaaatgcccctcctaccttggcctcccaaagtgttgggattacagacatgaggcactcagcccagccaatataattcttttttttttttttgagacagtcttactctgttgcccaggctggagtgcagtggcatgatcacagctcactgcaacctctgcctcctggactcaagctgtcctcccacctcagcctcccaagcagctgggattatgggtgcccatgaccacacccagctaagtttttaaatttttttagagattgaatctttctttttctcagcctggtctcaaactcctgagctcatatgatctgcccgcctccgtctcccaaagtgctgcgattacaggcatgaaccactacgcccagcctacaatttatttgtaatccaagttttattgaaaaaaaaatccacatataagtggacatatgtagatccaacctgtgttgttccagtgtcaaccatatataccaataattcttttttttttttttttttttttttttttttgagatggagtcttgctctgtcgcccaggctggagtgcagcggtgcaatctcatctcactgcaacctctgcctcccgggttcaagtaattctcctgcctcagcctcctgagcagctgggactacaggcatgcaccaccacgcccagataatttttgtatttttagtagagatggggtttcaccatattggccaggctggtctcaaactcctgacctcaagtgatccacccgccttggcctcccaaagtgttgggattacaggagtgagccactgtgcctggcctataattctttacgtatattgttagattcagtttgctagtattttatttagcatttgtgtatctgtgttcatgagaggtattgttctgtagttttctttggtttcttttctgtctggtttagggtaatgctggcctcatagaataggttaggaaatatttcctctgcttctgtttctgaaagagaattgaggtaatatctatttttttttttttgagatggaatcttgctctgtcgcctaggctggagtgtagtggcgcaatcttggttcactgcaacctctgcctcccaggttcaagtgattctcctgcctcagtctcctgagtagctagaattacaggcatgcaccaccatgcctggctaatttttgtatttttagtagagatggggtttcactatgtgggccaggctggtcttgaacttctgatctcaggtgatccacctgtcttgtcctcccaatgtgctgggattacaggcgtgagtcactgtgcctggcccgagataatatctaatttaacagtttggtagaattcaccagtgaacccatctgggcctggtgccttttgctttagaaggttattgattattgattcaatttccttaatagataaaggtgcattgagattgtcttttcttcttgggtaagttttaatacattgtgtctttcaagaaattgttccatttcatctaggttatcaaatttgtgggattagagtccttcataatatttctttgttttgcttttggtgtccataggttcagaagtgatggccctttttcattttttctattagtaatttgtgtctttgcccttttttttctttgttaatctggctagaagcttatcaattttgttgatcttttcaaagaaccagtttttggtttcactgatttttctctattaattttgttttcaatttaattgatttctgctctaattggttttcttctgctcactttggatttaattttttttagtttttctagaaaactaagtttttaagtgaaaactgagattattgatttttagatcttttttctaatgtttacagttaacactgtacaatttcctgtaagcactgctttctctatatcttacaaattttgatgtcatattttcattttcatttagttagaaatatctcttgagacttctttgacccatctgttatttagaagtgtattgtttaatctccaagtatgtattttgggatttttctggctatctttctgctgttgatttctagtttaattacatgtggtctgagagcataccttgtatgctttctattcttttcaatttgttaaggtgctctttgtggctcaaggtggtctactttttttttttttttttttttaaagaaaagctggccaggtgcagtggcttatgcctgtactccagcactttgggaggcgtaagtgggaggatcacttgaggtcaggagtttgagaccagcctgggcaacatatagagacttcacttgcacaacaaatttttaaaatattagttgggtatggtggcatatacctgtatatggctgaagtgggaggattgcttgagccctggaggttgaggctacatgagccatgatcgcaccactgtactccagcctgggcaacagagtgaaattttgttctctcttgaaaagaaaaaaaaagttgatgacataaagttcattcatcttttttgtatgtgacttcaaaataactactgatggttaaaaaaaaaatcagaatgatgcaacccaagtgtccatcaatggatgaatagataatatgtggtgtatgaatacaatgggctactattattcagcctttaaaaataagaaaatgctgacactgctgtaacatggatgaacgttcagatcattatgctaaatgagaaaagccagacacaaaaggacaaatattgcatgattgcacttatatgaggtatctggaatataagagtcatagaaacagtaattcagtaattagaataatgcttgccagggcctgtggggaggagggaatgaggaattcatgtttaatgggtacagagtttcatttggaaaagattaaaaagttatggaggtggatggtggtgaggattgcacaacagtgtgaatgtacttaataccactgaactgtacacctaaaaatgattaaaatggtacattttatgttacatatgttttacaacaatttttacagatggaaaaaaattataaaaaacatcaggatggtgttgacagtgaaaaggttaaagagttactttaaaaatttactttattccagccgggtgcggtggctcacacctgtaatcccagcactttgggagaccgaggcgggtggatcacctgaggtcaggagtttgagaccagcctgaccaacatggagaaaccccgtctctactaaaaatacaaaattagccaggtgtggtggcgcatgcctgtaatcccagctacttgggaggctgaggcaggagaatcgcttgaacccgggtggtggaggttgcagtgagccgagatcttgccattgcactccagcctgggcaacaaagcgcaactccgtctcaaaagaaaattttttttttttactttatcccaaatgtttatatttactttggggcttatgtgaccagtttaattttcatttgtaattgacttgatagaacacactaatgttcagttaagatttcttatggtgtggtgaggagtaggatttttatgtaaataagcccaaaattgtatatatgaggttaatctgatatttgcagaagatattcatgcattactgtaaggaccactctgcttattcatttgaccgatttgttacaacatggttagaaatcatcaaggtgtttgagatcaaaggatcttcagaggtgatttactccaatccttttttaaaaaattaataacttgagcctcagagaagttaagtgacattaccaagttctgctgttagtatagtgactttatctttacctgaatccagggtttcttagccctagtctgtaatgtgtcctagtgtgcctctagaatctggtcctgtcagcccaagtctgttaaatcaaataaaaccagggcttggtgcttcaccttgtcttctgccataccgttgggtttcctgtggaccatgcagataatgatgatgggctcagtgggcttgatagtgataactcctaaagcagctccttctaagtgcggttctcaatctgaggaagttaaaaaaaaaattagtgactagaacccacttctcaggtactctgataaaatacatttgtaggggagtgatagttttcactttctttttttctttttcttttttttttgagatggcgtctcgctcttttgcccaggctggagtgcaatggtgcgatctcagcttactgcaacctctgcctcccagtttcaagtgattcttctgccttagcttcctgagtagctgagattacaggtgtgtgccaccatgcctggctaatttttgtatttttattagagacgggatttcaccatggttggtcaggttggtctcgaactcctaaccttgtgatctgcctgcctcagcctcccagagtgctgggattacaggcatgagccactgtgcccagccttcacatattttttgaaataataggccagttgcggtggttcatgcctgtaatctcacactttgggaggccgaggtgggcagatcacttgaggccaggagttcaaggccaccctggccaacatggcgaaaccctgtttctactaaaaatacaaaaaaattagccgggtatgatggcatgtgcctgtggtcccagctactctggaagttgaggcatgagaatcgctttaacttaggaggtggaggttgcagtgaggcaagatcgtgcccctgcactccagcctgggtgacagagcgagactccatctcaaaaaaaaaaaaaaaaatcgtatgcagtaaaggttgaaaactgctgcccaaaggcgctattaaactataggttcccaaacctggccaattgtcaaaatccctcaagaaggggcagtggggtctaagggaccccattgctgtagaggagattagtagtccaagagtgagatgaactgttggaagtcctcaaacttccaaactattaaaatagaatagttttgcttccttaaaatagaatagttttcttcctcactgatttttctgtattgattagaaccataacaagtgaattaaacaactacaaaatagttatgtgggccacagacattattgtaatgaagtgaagtttggctcaggccttgtaacacaattgctttttggattaaaagtaaaaatattaaattgtgaaattatgtgtaagttttaaaaaattggtcttgtacaaaagtgttgggtttttctttgtttttaactggatttgtttttaagcaagacagaatatttatattgttggagagtcacaaaggaggtgtgtttgtggatttaaatgtggagacagtgtgccttgaaatgccctttatcagtctgattcaagccacctgcaatcatggatttgaacttttttttttttttcccctgagatagggttgcctaggctggggtgcagtggtgtgatcttggctcactgcaacctctggctcagcctcttggagtacctgggactataggcacacaacatcatatccagctattgtatttttttttttttttttttttatagagacagagtttcaccatgttgtccaggctggtcttgaactcctgagctcaagcaactcacctgcctcggccttccagagtgctgagattataggtgtgagccaccatgcccagccttcactttatttaaaaaccatagtttttaaaagccacattcctactgatgaacacagaggttgtttccagtgttttcatttgcagggctgtagtgattgtttttgcacatgcctctttatgtacatgtgctgtgtcttctgggacagagagtggacattttaagtgttttattggtcctgctaaattgtctttcagccaaactgctgcagaggtgatggagatgaggtgggtactcaggagaattatgctcagtgcttgtgtgctagtcactgacctggaaacattttattaaaaatgctagattaggttagtgatgtaaataccaggtgatagtaaccagaataattgtgtcaaaacatcaagaatcatcaagagatgccaggcatggtggctcatgcctgtaatctcagccctttagtaggaggccgaggtgggcagattgcttgagctcaggagttcaagaccagcctaggcaacatggtgaaaccctgtctctaccaaaaatacaaaaatttgctggatgcagtggtacgtgcatgtggtcccagctactcagtaggctgaggcgggaggatcgcttgagcctgggaggcagaggttgcagtgagccaagactacactacagcccgggcaacagagtgaaaccctgccataaaaaaaggagaaaaagaatcatcaagagaaaacttaatttgatgtgctctgcgttttctttggtgcttcatgtcagtgttagaaactataggttgtatatttattaatttttctcctacatttgttcaacttgactaaaatattaactccaaatgcctagaatttcaaaatacctcttcgttataaagtatcaactatttcttagtccccttaagctgatagtattgtgtcattgtaaaagatcccttgtgaaaaataatttttgtcaacatgaaaggtcttaatgtgtctcctagtttacattttacatggtcttttccatgtatttatatagttgacatatatagctttttttgtaaatacactttcctatgtgaacatgccaaggtttacttaagcattctcttattcttggacatctaaattgcttcttattttctattgtaaataaagtgctagaagcttctttcctgaaaagttatttacttttcacctagtatttccatctgtgttcctcaaaataagattgctgagattcatgtatgttgccagaaagattgtgaggtttaacagtgaatgaggaaaacttttaacactcaaggtctaccaagtacagcaagttttattttacctttttttttttttttttttttttttttttttgagttaggccaagttgcctaggctgggctcaagcaatccttctgcctcagcctccggagtagctgggattataggtgtgcagcaccacacccggctttcttgtattttttttttatttttatttatttatttatttttgagatggagtttcactcttgtcacccaggctggagtgcaatggcccaatctcgactcaccgcaacctctgcctcccaggttcaagcgattcttctgcctcagcctcccaagtagctgggattacaggcatgtgccaccacacccggctaatttttctatttttagtagagacggggttcctccatgttggtcaggctggtctcaaactcccgacctcaggtgatccacccacctgagcctcccaaagtgctgggattacaggtgtgagccaccgtgcctggctgctttcttgtattttatcttgctgtagcggttgtgggatttttgcctggtgtgttcattggagtgtgtgtgtgtgttttgagatgtatgactgtgttggttgtgttgtcatactttgaaggttcattaatgtgctggtctttctatttttcttgttatacttagtcacttaaaaacccttttttttttttttttggaattcttatttttacagtactttgaattcctgttttattaatcaccttcttatctgaaagtgaagtaatagtgtacttggcaccattgaattagaaaattgtgtgtccttggccagaagatcacatacacaggaactcgataagttgagagatttagccgtttcagaaatgggcatttgtgtcttccagtggagaagcatctgcaaaagaattgggcagatttggccaggcgcggtagctcatgcctgtaatcccagcactttgggaggccgaggtgggcagatcacctgaggtcaggagtttgagaccagcctggccaacatggtgaaaccccgtctctactaaaaatacaaaattagccaggcgtggtggctaacccatttaaagtgggtgaattatatcttttatgttttaatgtattcctagagttgtgcaaccatcaccagaataagttgtagaacattttcatcaacccaaaaagaaactttgtattcattagtcgttcctcctcatttctcccctaacctcccagcactaggcaaccatcagaatactttttgtctccacggatttgactgttttggacatttcatattaatggaatgcacaatacagtagtataatacattaattttggaaggccaaaattaatggcttttgatgtctgccttttttcacttagaataatgtcttccaggtccatctgtgttatagcatgtatcattactttatcctttatgtggctgggtaatattccattgtatggttataccatgttttgtttatctattcatcagttgatggacatttaggttgttttccattgactattaagagtaatgctgccggccgggcgcggtggctcacgcctgtaatcccagcactttgggaggctgaggcgggtggatacgagggtcaggagatcgagaccatcctggctaacacggtgaaaccccgtctctactaaaaaacaaaaaattagccgggcgtggtggcgggcgcctatagtcccagctacgcaggaggctgaggcaggagaatggcgtaaacccgggaggcggagctggcagtgagccgagatggcgccactgcactccagcctgggcgacagagcgagactccatctcaaaaagaaaaaaaaaagagaataatgctgccatcatgcttgagggtttttttttattttgttttgttttgtttgtggggggagcggagggcacagtctcactctgttacgcaggctggagtgtagtaggcttactgcagcctcctccgccccctggttctagtgattcttgtgcctcaggctcctgagtatcatgctgcaatttttgtgtgagcatacatttttcatttctcttgggtcaatatctaggagtatccccacttttggttctgagtgttaattgagcctgttgtgttctcacattccctgtacttagatggaaatagtgctttgcctaaaaagaaaataaaagacctgattgtgcaggcgagtgagaaagagagagaggcgctagggttatttccaccctgatactctttgggtagtcttggtatgactagcaaagaagcaagctccaagttgtagtttgcttccaagtttctggcttctgtgggaatttctgcatctaagtaatgacaattttcagttacttgcagtaagtaaattatcaaccaatcttactgtgtattactagcctagtaggaatttacttgtatatcgagaggaatgctgcagctttcaccttacttctaatggggattaatgcttacttaacttgcagttttggaggcaagtacaaagtacaggaccaattatggtcatgaagtgagagagaagtctggctagtgaatggtgattggcaactccagttgactgttcatggcatcttagatctgtgaggagggaggagggaaggaaagttcaagctggtctttatggtaagttctggaacatttccctgtgtcaatgggtcatctgttcattcactgtgtaaaatggttgagggaagttttaatttacatgcttccttattgtgtaaacctttgatttttagtgatttcagagtttgtttttataattacttaacacgtgaagaggatgcagagtaacgtatcgaagctctggttaccttccactgggatttgacacatttgatttcctttattccctccttccttcccttcctccctctctcttttcttaaggaatgcaactactcagattcacctgcacacccttggcatacctctcactcccccttacccccacttcctcagaggtgacctgtcctcagaggcaaatgtgtgccctttccatccgtacttttatgctctcatctatgtttacatctattagtacactattgtctgtatttttaaacattacataaatggtgtaatttttacttttaattctgtagtggtgtttctcaaattaagttctgcacaaaacatttttatagatatccagtgttagcttaacgtttttcttattgtggtaaaatatacataagataaaatttaccattttagccatttttaagtttacaagtcagtggcattaagtacattcacagtgttgtataaccatcaccattgtccattgccagaacttttcatcatcctaaacagaaactctgtactcattaaacaatagtttatcactccttccctgcaactagatgctggcaatcaccattctactttctatctctatcaatttgcctcttccatctaagtggaatcctacatatttgtcgctttgtttctggcttttttttcttcttgtgatgctttgttttaattatgttcctggctttcatcatctagcaggctgattccaaggtttgtccatgtggtagcttgtatcactttaatgtttttagagatagttaatattacattgtttatatataccacattttgttttttcattcaaccttgatggacatttgaattgtttccccctttacctgttgtgaataatgctgccgtgaacattgataaccaaatatttgtttgaatctctgatttcagttcttttggttccatacctaggagtggaattgctggatcatatgataattctatgtttaactctttgagggatggccagacttttccaccatagctaaatcattttaccttcccacaagcaaagttcaagggctccagtctctccccataaggtcctttgcacttttttttttgagacggaatctcactctgttgcccaggctggagaacagtggcaccatcttgcctgacctcaagtggcacctgccttggcctcccaaagtgctaggattgtaggcgtgggccactgcactctgccaattttttaatttttattttcatttatttttctttttttaatttttaatttttttattttttgaagggataaggtctcactttgttgcccaggctggtcttgaactcctggcttcaagcaatcctcctacctcggcttctcagagtgctgagattataggtgtaagcccctgcacatggcctttactctcttgatagtgtcctttgatgcacaaaagctttcaattttgatgaagtttattttttatcttgttacctgtacatttggtgtcatatatctaagagaccattgccaaatgcagtgtcatgaagctttccctcagtgttttctttctgcagttttatgattttagctcctaagtttaggtctttgatccattttgagttaatttttgtatacagtttgagagtcacacttgaggctctgggcgcagtggctcacgcctgtaatcccactacttggggaggccgaggcggatggatcacctgaggtcaggagtttgagaccagcctggccaacatgccgaaaccctgtctctactaaaaatacaaaaattagccaggcatggtgatgcatacctgtggtcccagctacttgggaggctgaggcaggagaattgcttgaacacaggaggcggaggttgcagtgagccgagattgtgccactgcactccagcctgggcgacagagcgagactccatcgtgcggggtggggggtaaaagtcaaacttgagtcttttgcctgtggatatccagttttcccatcactatttgttgaaaagactatcctttctcaactgtgaatggtcttggtaccctagctgaagttatttttattattatgttacttaggaatgcacataaggcctggcacggtggctcatgcttgtaattgcagcactttgagaggtcaaggtgggaggattccttgagccgaggagtttgagaccagcctgggcaatatagcagcaagaccccatctctatattttaaaaaaagaagaaaaaaaaacctctgatgcataaaatatttaaacttgtatgcattcttttctttctttattttttaaaaattgagacagcagcttactctgttgtccaggctggtcttgaactcctgggctcaagcagttcctctcaccttggcctgcagtgctgagatgacaggtgtgaaccactacacctggcctgcttacagattataaaaagaaaataagtttacaagttaaagacagataaaatgacaaaatcagtaaaattaaaattacttttatggagccgatgatgtttattccagttgctcctctcattgtgaatatggtattgttgctgtggcagatttggaggccgtggcagatttggaggctttggcaatggcttctgttaccttgccatgaggtaactcagttccctcatcacttttctctgagaactataaaaccttggaggggtgccttctgcccttcgcttggcatgtatattatgcagggatcaggtcttactccgttcttgattgttagtacaaattagttaaaattgtattgtttggccttagcctgatggtaaacacaacagcacacgtgggctgtgaaatctctgggcagctctgtgtttctagggaagcatctcgatgatccagaacaggcttatactaatgttttagtgtaattttgaaatgaaaacacagcatttaaaaattcttatagagaatgtatagaccttgagaagtgttagcagacccagtttacgacatgtctcaatattatgaaacattgctttattccctatcctgcttgtacatttaattttttcatccagttttaaacaacttgggtactgtggcctgtgcctgtattcccagctactagggaggctgaggcaggaggattgcttgagcacaggactttgagggctgtagtgagctgtgattgtgcctgtgaatagccattgtgctccagcctgggcaacatagcaagaccctgataccttgggtttttaaaaaacaaaacaagatacatgctgacatttctggtttggcaggcagagcttgttctgctccccaccctcccttttcccatagtaaccatttataggacatctcactgttgtctactctgtgttgcctctgcttccctgcgtggtagatctaggaatcttaggatttcttagttttagctggtgatccgtatctttttcttaattccattgtaacttcagcttttcttattgcttgtaggaaggctgtttccattgaatacaaacaaaataaaagcttttattcttaatcttagagataggatgtttgtatttaaaaataattgtgctgtcaaaattctgtcaagttggcttttaccacattagttttttttaatgtggtttatatgaccctggagtaccttgtcttctcactgttaaattctcaactgagttgtccctatttaaagtgtgagactgtgccagtttgattttaaaatattgcaagtgcgttatggcaagataaaactgcaaagaaagaaccttcatgtccctttgattataaatgcttttggcacttgtttctactttttcctaatgttttttgaggaaagaacctccaactctccagacaggtctgggggcaaatgactaaaacatgaactgaggccctgggctgtctctgtgaggatatcccctctattctctctgaaatgtcccagcatgtggtgcatttcttgttagtgtggactcctctgtatataacacatcttatttatcttctgtgcataacatgaagtagtgccctaatgcaattccaggatgtaattcagcatttctataaaaatacagtgtttttctacatttgcatcaaaaaataaccagataattatatttattaagaaaatagcatttttggctgggtgtggtagctcacgtaatcccagcactttgggaggccgaggcaggcagatcacttgaggtcaggagtgaggcaggcagatcacttgagatcaggagttcgagaccagcctggccaacatggtgaaaccccatctctactaaaaatgcaaaattagcctggcgtagtggtgcatgcctgtaatcctagctactcaggagactgaggcaggagaatcacttgaacttgggaaggggagattgcagtgagctgagattgtgccactgcactccagcctaggcaacagagtgagactctgtttcaaaaaaaaaaaaaaaaaacaaagaaaagaaaagaaagaaagaaatgtatttttggtatttgttttcacaaactagagcatttatgtgaaataacattgctagtattgatattataccatagtataatacttagttcttcagcgatgtatctctgctgatcagctacatgatatctacttgagctgttggattttttttaagaacagtgcatttttgaatgcttttgaaaaattgtagtaaaatacataaaacaacatttaccttgtaagcattttaattggtacaattcagtgacattaagtacagtcccagtttagtgcaaccactgttactgtctagtttcagaacgtttttgccccagatggatactctgtacctgttgaacattcagtcctcatggcccaataatctttatgtctgtatagatttgcctattctgcatattttatataaatggaatcatgtcttttgtgtctggcttcttttacctagcatagtattttcaaggttcatccatgttgcagcatgtttcaatactttgttcctttttatgtccattgtatggatatgccacatttcgttaatgacaattcttttgggtagctacattttaaaacattatagtagaatacatatagcatacaatttactatcttaaccatttaagcctgcagttcagtggcattaaatacattcacgttactgtgcaattatcaccaccatctgtttgcagaaacttttcatctcctccatttgaaactctgtatacattaaacatgaactctcccttctccccttcctccagccctggcagccaccgttctacatttttatctttctgacagagattttactactctaggtacctcacataagtgaaatcaaccagtatttatccttttgtgaccagcttatttcattagcttaatgtcctcaaggttcatccatgttgtagcatatgtcaacatgactttccttttaaggttgaataatattccattgtatgtatatgtcacaatttgtttctccatttatccatcactggacatttgggttgcttttacctatcggctgtcttgaatcatgttgctatagctgtacaagtatctatttgagtttctgctatcaattctttaagtatatgcccagaagtggaattgctggatcatatggtaattccgtgtctggttttttttttgaggaagtgccatgctgttttccacacagctgtaccattgtacattccccccagcaatgtacgagggctctgatttcttcacatccttgctaacacttagtattttttttgatagaatagccatcctaatggctacttttaaagtatgtttaacattatttatttatttttaattttttttgtagagatggcatcttactgtgttgcccaggctggtcatgaactcctgggctcaagcagtcctcctgcttcagcctcccaaagtgttcggattataggcgtgagccaccatgcccagcccaaatttaaatatataactaaacacatagcagctaacaccaagcctttaaaaatatcattaataggccaggcgcagtggctcatgcctgtaatcccagcactttgggaggccgaggcgggcagatcacctgaggtcgcgagttcgagaccagcctgaccaacatggagaaaccctgtctctactaaaaatacaaaattagccgggcatggtggcacatgcctgtaatcccagctactggggaggctgaggcaggagaatcacttgaacctgggaggcggaggttgcggtgagtcgagatcgcaccattgccctccagcctgggcaacaagagcaaaactccatctcaaaaaaacaaacaaacaaacaaaatatatatatcattaataggccgggcatggtgtctcacgcttgtaatcccagtgctttgagaggccgaggtgggcagatcactggggtcaggagttcgataccagcctgggcaacatggtgaaaccctgtctctgctaaaaatacaaaaattagccacgcatggtggtaagcacctgtaatcccagctactcaggaggctgaggctggagaatgcttggacctgggaggtggaggctacagtgagctgagatcacactccagcctgggtgacagagcaagactctgtctcaaaaaaaaaaaaaaaaatcattaataaatgtgatcttttttcttcctatacaacaagttgtcaagcaagtatgaccttcttaattgaccctttgacatgaactgggatgagatcgtggaggatgttgaggagacagttgttaccatagtgcacttctaaaaactttaattctatagatttctttaaaattttttttaaaattattatgagtacacaataggtgcatctatagatttcattaccctcaaataaatgtacaaggcaatgcagagaaatgcacagtgtaacttggtagacttgacctatcaagttactgttgaatatattatggagcctgtgtattaccaggggcagcagacttttcctgtaaagatagttgttttcagctttgttgaatctgtggtctctgtcttaactacaactgagaaagccattgacaatatatagatgaatgtacatgactattctaataaaactgtgtacactgtaatttgaattgcacataattttcatgtgtctcctgtataattcttcttttgacttcttttcaaccattaaaaaatgtaaaaacaggccaggcgtggtggctcatgcttgtaatcccagcactttgggaggctgggtggattgctggagcccaggagcttgagatcagcctgagcaatgtgatgaaaccctgtctctacaaaaaattagctgggcatggtgttatgtgcctgtggtcccagctacttgggaggctgaggtaggaggattgcctgaacccgaggaagtcaaggctacagtggtttgtgccactgcactctagcctaggtgacagagtgagaccctgtctcagtgaatgaatgaatacattattagcttgtggactatacaaaaatcagaggctggaggtgagctgggtatggccattgggtgtggtttgctgacttctggtagagaggaattaggagatgttaaaggtggtggaactgtcagatacttgcattcttttagaaatactttggagttagctttttggttcaggcaaaggaccaaagggttaggagagtcaggccggtaaagaggagtggtgggcccatagcagcagttcctggagttttttttttttttttttttttgtgagacggagttttgctctgtcgcccaggctggagtgcagtggcacgatctcggctcactgcaacctctgcctcctgggctcaagcaattctcctgcctcagcctcccgagtagctgggactacaggtgcccaccgccacgcccggccaatttttttctatttttagtagagatgggatttcaccgtgtttgctaggatggtctcgatctcctgacctcgtgatccacctgcctcggcctcccaaagtgttgggattacaggtgtgagtcaccgcgcctggccaggtcctggagtctttaagaggaggtttgtctgatggttggttggacaaaagcctgggcatgttgtcaccttccataagtgtttgtgggaatgtaggtaatgaggaggagtaaaggattcctgaaggatgaggaggagggctggtggctgccataggaagtgatcactgttttggcagacctgtcttagagtaatgaccgtcatactctctcattgcccttgtgaactcatgaaatcccatggctgctaaagctgaaggtcaagtggggacttcccggccactgggcttagcaccccacagagctgtggagtgggcattaatgtcccttttttatagatgcggagactgagaatgaggactgttggtaacttttgaaagggcactcagctagaaaagtctgagccaggatttcaagtcccatggctttacctctgtggtcctaatatttggtgtgttcaagtgagatctgtttttttcctatttcattttgattattgattttcataaatttttttctcttttgagatagtatcttctctctcttttcttttttctgttctttctttctcttttctttctttttttttttttctctgagacggagtcttgctctgtcgcccaggctggagtgcaatggtgcaatctcagttcactgcaacctctgcctctcgggttcaagcgattctcccatctcagcctcctgagttgctgagattacaggcacctgccatcttgcctggctagtttttgtatttttgtagagacggggtttcatcacgttggccaggctggtcttgaacttctgacctcaggcgatccacccgcctctgcctcccaaagcgctgtgattatatgcatgagccaccatgcctggccattatttctttctttctttctttttctttttttcaggttcattgaatttgctttgagacagggtcttgctctgttgcccaggctgaagcgcagtggtgcagtcatggctcactggagcatcaatttcctgggctcaagcgatacttgcacttcagcacccctccacccccacccgctcctttcccccacagtagctggaactacaggcgctagccaccgtgcttggctaattttttttttttttttttttttgagacggagtctcgctctgtcacccaggctggagtgcagtggcgcgatctcggctcactgcaagctctgcctcccaggttcacatcattctcctgcctcagcctcccaagtagctgggactacaggcgcccgccaccatgcccggctaattttttgtattttttagtagagacggggtttcaccgtgttagccaggatggtctcgatctcctgaccttgtgatccgcctgcctcggcctcccaaagtgctgggattacaggcatgagccactgcacccggcctggctaatttttaaatttttttttgtagactgcccaggcttgtttaattgattttctatgtgatcttagggaaatcgattatttcccataaacatttttttaattagaagttaaattctgcctagtttgattcacaggattattgtggatgactgaaacagagaataggtaagagcttctttgaaaaatatgaggtaccatacagaagttagatgctttgtcctggtgataccccctccaaagcacagctaaggaaatgtggaaggcactcttatctcatcatatagctttgaaagcctagcattgaaagtacgaacttgattcttttggagaaatcctttggctctcagtgagtttactttctattaatgactgtgttaagcggaatgaaaactgaaagaggaaaggggaggaagtcagaattaagcaggaagagtgagcccatagcagagtccagatttagaccccaagctacttggaatgatactggacaattatgggtgtgtttaatgatggtcctgagtcatgaaaacaaaaggaggctttaaattatgtctggcttagtgtacagcatatttttgtcattattcaagttttagcatgtaaagaggaaagtgtgcagtacttatgcatatcattttcattaatgaaactaaatgaggcctctttaaaattatcagtgttcacagtatcttccaaaagacatgtaaatgtataaaggtataaaaaatatacatataaattttacaattttgtgagctatatagtagatctcttattttgtccataggtcttaaagatcttatactgtattcaggaataaagataacttcagtgggaggcctttacagggctaatgagtaagcattattttgataaagttctgtgttgtctacaatagatatagtagaaatactcttggaatggtaatcatcccaggccctgctttggagcggaagaaatagtcaatgtagaactttacagtatattgtacacagatgtgcctgctaataacttctgtagacagcaaagtttaagagaaattaggtggtaaatgcaacatatgtatctaaataaatttggtctgagggatttgataagatgaaacagtacatagtccagaaaatttttatactcaaagaattatagaaaatatctgaaatgttttcagttttgtgcatatccagaaaatgtcatcctgtgatctgctggttggcagcccaatggcagtattagatgtattgtttttattttgttttgtttgctatttatttggttaagagagttacctaattaggagtgtgaaaaaaaagatttattatagtagtgggcttttgtttgacttaaaacatttttgttgttaccacagtatgagtgccttgtttgtgaaatttgtttaccgggaagccatatacttagagtagcttttagtttatcattatcatcatcatcatcatcatcatcatcatcatcatcatctccttcatcatgaaaggaagaagctaccaatgttgctttattctgcaaaaaatacaatagatgcttgttgaaagtatggagtgaaatcttaaatatgtctgttaaaaagagtacaactggccaggggtagtgcctcatgcctgtaatcccagcactttgggaggccaaggcgggcagatcgcttgagccaggagtttgagaccagcctgggcaacatggtgaaatcctgtctctacaaaaaaaaaaaaaatagacaaaaattagctgggtgtgatggcatgcagctgtagtcccagctacagtggggctgaggcagggggattgcttgagcccaggaagtaaaggctgcagtgagctatggttgtgccactgcattccagtgtgggtaacagaacgaaaccctgtctcaaaaaaaaaaaaatagtacaactttaagcaggatgtgggcacatgcctgtagtctcagctacttgggaggctaagtcaggagagtcacttgagcccaggagcttgatgctgcagtgagatgtgattgtgccactgccttccagcctggggatgatagcaagaccccatctctaaaaaaaaaacaaaaaacaaaaaaaaaacagagtacaacaacctttggtaaacttggaatataaaggtgtttccttaacctgttaaagagctgataaagagtggtactttcaaaccagtacacattatgtgaaacactagagacacttcccatttgttaaaagaaaaaccttagccaaattaaatttaagttttttttggagacagagtcttgctttgtcacccaggctggagtgcagtggtgcaagcacagctcactgcaacctccgccttctgggttcaagtgattttcctgcctcagcctcctgcgtagctgggactacaggtgtgcaccaccacgcctgggtgatttttgtattttttgtagacatggggttttgccatgttgcccagtctggtcttgaactcctgggctcaagcaatctgcctgcctgggcctctgaaagtgctgggattacaggcgtgagccaccatgccatttaatggtttaattgagcaaagaatgatttgcaaattgggcagcctcccgagccagagtaggttcagagactccagcacagccatgtcgtggaaaaagatttatgaatggaaagaggaaagtgatgtaccgaaaacggaagtgaggtacagaaacagccggattggttacagctctgaatttgccttatttgaacacaagttgaggtttgtacagttggccacctttgattggccaaaactcggtgattggcacaagagcaggttatagtctgtttacatctccattttggttatagttcattatggacagaaaaacctgtaggtcaaacttaaaatatgtaaggagacagttttaggctaaacttgatttaacacattaaatccgtaacaagacaggatgcctgccctcaccatgttatttgatcttattttagtaattctagccaatgtagtagggcaagaaaactgcctgcttggctacaaaataaacacacaaaagtcagtatctgtaatatgtgacagaaaatataattaaaaaaaaaaaaaaaagccgggcacagtggcccatgactgtaatcctagcactttgggaggccaacgtgggtggatctcttgagctcaggagttcaagaccatcctaggcaacatggcaaaaccccgtctctacaaaaaatacaaaaaaattagccacgtgtggtggtgagctcctatagtcccagctactttggaggctgaggttggaggatcatttgaacctgagaagcacaggttatagtgagctgagatcacgccactgcactccagcctgggtgacaaagtgagactctgtctaaaaaaaaaaaaaaaagaagaaaaggaaaggaaagtaaaagaaaaaataatttcacttactagagcatcaaatccctaagataatttagagcaaagccagaaaagtgaagaaaatataaaaatctttacagtgggttgcattttaaaaaaaaacttgaagatatcagatcaactcactaatgtattaattaatataatttaaattaaaatcccactgatttttttgtggggagggtgggagagtcatttgttaaaatgattctaaagagcatctggaagaataagcaggcaagaatagccaagaacattttgaaaactaaagatgagtttggaagacgattggttttgtactgtcaactacttatagattttacatgaattttaaagggtaatctgagccctcgaatagacagaaatagccatagatctgaaagaacacttaagacctgatccagctatccatgagagtatatataatcaaagtctttgtgtgtgaatcaggagtctttcaggtgcaaggtaaataaactcataattgcttacgcaaaggtggtatttgctttagtgactccagagaaagctcaagtgcctatctctcccctgactttgattctttttggggttggctccattctctcctgttgctaatggcttcctttgtgcagccagaggaaaggaggtgtggttttttgatacttccaggcttctatttttatagcttgagatcaaagagggaagtgaccttccttagagtcagtgtgtaaagtcctaaggaagataccacgtggggtgctggggccatgtgcccatccctggcccatgaccatggggatgctacactaactgggggccacgcatggctgttcctgccctgaactgccagctggctttgcagtgcagcctcaccagaatcacatggaatagtagggatatgaattgtttcccaaagaaagtgtgtggggtggtagaattactagtgggggagtaaggggacaggccattgggcatactggagcagcatttactcagtcattgagaaaaggatggaacattcaataaagggtgctggacacatttgtgctctaaaaattttgtgtttcacctattaatttatccctccccttagcccctggcaaacactgatctgtttactgtctccatagttttgcctttcccagaatgtcacacccttggaatcatacagcatgtaaccttttcagattggcttcttttacgtagtaatatgcatttaggattccttcatgccttttcctggattgatagctcatttctttttagtcctgaataatattccattctatggatataccacaattgatccattcacctactgaaggtcattttgattgcttccaagttttgataatttaaaaaattttttaagacagggtgtcattgtgttttccatactggtctcctgaacacctgggctgatgtgaacccctctcctcagcctcctgggtaactgggattacagctatacaccactgtgcccagtgtgacaattatgaataaggctgctgtaaacttctgtgtaggtttttttgtgtgtggacattggttttcagttcattatggtaaataccaaggagtgcagttgctggattgtatggtaaaagtatgtttagtttgctaaggaactgccagctgggtgtggtggctcatgcctgtaatcctagcataatgggaggctgagacaggaggatcccttgaagccaggagttcgagactagcctgggcaacatagtgagacctcatctctacaaaaaatttaaaaattagctgggcgtggtcttatgtgcctatagtcctaactgcttgggagactgaggtgggaggatcacttgagcccaggagctggaggtggcagtaaactgtgatcataccactgcactgctgcctgggtgacaaagcaagaccctgacttaaaaaaaaaaagagaaaagaaaaaaagatgagtcagagggtaaggaagcaaaaataagtaaataaataaatagaagagaaaagaaaaaagaaaaaactgtctttcaaagtggctgcgccattttgcattcctaccagcaatgaatgagagtctgttgttgcacatcctcaccagcatttggtgttgtcagtgttctggattttgaatattctattaggtatataatgctgtctcacttgttttaatcaatgatatatgacattgagcatctttttaatatgtttacttctcatctatgtatcttctttagtgaggcctttgtttaggtcttctgcccattttaaaaaatgggttcattttcttattgttgaatatcatgagttctttgtctattttgaatacctgccttttgctttatttttgtgttttttattttttttttttattgagacaagttctcactctgttgcccaggctagagtgcagtggcatgaacatggctcactgcagcctcaacttctcccagcctcaagcaatcctcttgcctcagccttccgagtagctgggactataggcacacaccaccatgccctgctaatttaaaagagtttttttttgtagaggtgggatctcgccatgttacccaggtggtcttgaactcctggcctcaggcaatcttccagccctcagcctcccaaagtgctgattataggcctgagccacttagcctagctcagaatttattttttatttgttaattttgaaaaaatataggacctcataaaagtcagtctacatttgtacacattatgtttttggtgaatatgtaa

SEQ ID NO: 1142 - DNA, 1625 bp, Homo sapiens
gcatgaggtattctaaggtctattgttcaacgaataagatattacaactcccgtaatggtctctaacatgaataacaagattagagggacaatcagtaaaaataataaaagacaaattatcttgtcaattctctatttctagtaactcagcaataaaagccatttatgttctcatttggacattaaatagctagaaaataggagtcagtcatttcggatgcaaaattctgccacagcttcattccatttggtatcgtaggtatcagtttcttacagacatttccttttaaccacaggaaagaaaagatacccaatacggtaataaaaatgagcatttcaaatgtcctgtagacctaaagtagaaagcagaaaaacagaggaactaaaatgacatttctgatataagtttaaaatagaggcttatttctcatgatttctttatgaaaagacgtgtgaaacatgtataaattaggattgttcatggctaaaaggaggtcaggggtattggaggtattattaagattcactttatcttacattgatacttgtcctgtggataataatttctgctaagatgggttataagataagctttttaactaaaaatagaacaaggttactaagctataagaagagataatctgcatattaattcagtgaccagaaaacagtgtcatccaaggtgtggtctgaatggtctccaagtacattatgaaacaccttggttggctcacttccaattagagggaaaagtgcaataaacaccaatttcccacatggcatcatagaatgtactaaggtgtttattatcccttatgatactgcaataggaaaaatagatttctccttcccaggtaatttaatgagaagaacatcccatttcaaaaaaaaaaaaatctgtgcaaaagaaagtagcatgagcataatgaaactctgtgctgtatttaatgaactgatggcttaataaactattgccttggtgacaataaaaagttctgacctttgtatctataagaaatttttctagtaagcaaaattagcattcacatttaaatttggtgtttgcttccaatacttgatttgttattagttcctatttctacaagcctatatagttaacagagcagagctcctctgagctgttccagccagatggaacatttcatagtctcacatgggaagtggctggaatccaaacttctgtgcgatggagtttcctgtgcgtttggatctgtctgcaagttcttctaccaaaaggagtgaggtatgaagcatatcctcttgccatggacacacccatgcagaatgcagaggttgctggatgggacctgtagctgcagcctgaagacagctggccatgaaaacagatggggtccctgggctatgagaatttagtactggcaggtgaagtgtattggaaggtgtgggagcctccttaaattttgtgaaattaagagagagctgggtttgcagaagtccaagtgttgactctgaattcatgaacactgcatgtggaacattgccgacagcctgagcattctgttatttacagtacagactctgatgcaaagaagggactgttccaatgcagaatagcatgaaccacagaggagcaacatcagggc

SEQ ID NO: 1143 - DNA, 3091 bp, Homo sapiens
ctataaagtatccctgaaattgactcttcccaagagtgatccagaaaggctttaagccatggagcctcgcagggaactccagtgaaggggtcgcaccagtgggagtggattcgtttattctgctgagctggctaagcaaacagtcctgttattttccaacctcaataagaatatcatcagagccaagcttatttgccaagcaaagtatatatattctacatatgtgagccttcagggtggggcttggcccttaatttccctgctacagagactgtggctgagctgggttttggtgggtactaagtaaatactagttaacttgttgggtgtgtgttgatgatgtgggtggcatatgtacttttttctccccacctccaaggaccttttccccccacccttattatttctattacacttgtgatagaaaatttaggaaataaaaaagtatatatataaaaaagaagtgttcataactaaccagagaaaatcactgccaacacctgggtgcccttccttcctgatattttcagtgcatttttttttacccccacacaattatcctatatttataattgtctgttctgactttctgttttttctcaacattatatcgtaagtatttttctcatgttattaaggattctttttaaatttaatttttaaaagttttaaaagcatactatacctaagtagataaatgtttattctaatttaaatcttttattccaatagtcctagggattaaaaaatgaaataatgctttttatttattaacaaaaaggctgagagaaacaggatttgcccaagatcacccccaaagaaccaagactggggctccccagggctgtagtttgcatccataaatacagagagaataatgtttataatcttgggtataaaaacttctggtgaaaaggttgatcaaatgctagctgtatttctcccccttccatggctttctactgagtctctctctcctacaggaccctactttgctccataattaagcagcaaagtatttcaagagctgttcagattctagaaactcatagcagatgaaatcgacagataagtcagatatcgaatatagacattaaaagatctgggcactaggctgtaccctgttattgtcagtggctctttagtccttaaacaagggtcttgcctcctactttttttttgttatggtagaaataaatgcccacccgagttttcatcactcactattattctatctttggtgtgcctgtaccatgttcccttaacaatcctcaattatgaaacatttaggcagtttataaacaatactgcaatgaacaacctagtgcatactttttttgtgtgttcttcttttattatttcctagaagtgagccctagaaatggagttcctgagtcaaaatgacacattttatagctttttcttgttaaaaaaaaaattcagtgacacttgtgaaaacacggtaaggaagtctttattcaggaacattgccttgggcatagggaccactgcaacagggtcctacagtgagggagagagtttgggctcaactcctaatacagcatgggcgagtgggaattgatagctgcagagcagggtaggggtcagcggatggaaaattactaagaggaagctcaggaataagggatattcttgctaaaccgacctaacaaaattattgatgaagacaaaccagggtgattcaaacatcagtgggggcatggtggaggatgaggagcctgatcagatatcaaggatgaggggttctggctaaacagacttagcaggattcttttgctaaaactggattttacaaggaagtgcacaggtaggcctaggagaaggttcagaagcctggctaaagtttggccaagcaaataatctgtgtcatgctaaattttgccaaatttctgctcataaaggttacagtagtccttattcctaccagccatccgtgagaatggcagcattcttcaggagcatctgaagctggttataaaaagctcagctgtccttttatagaatagagtacagcgaccattttcctgaaacgttacatttcattcattcatttggcaaatacacttgcacaattcagcagcaataaagcataacaagttaagatcccaggccgaagaagtggagagaacttggttctccttctggtttatgttttgcacttgccctaagaccttgaggacatcacctcactgagtttcatttttctcagctatacagttagggcttcaatacccacttcacagaattctacaaagtacctaacacaatgcttggccagtgcaatcatgtggatgctgggaatttgtattatctcatctgactccaaagagccctggaaaggaagcaggtagggacagatccttcccatttcatggactcagagaagaaacggccatgtttcttggtgtcctgagcttcacttcaggaactggtagtccaaaggaactgtatcgttcagaacggaggtaaaacaggcttttgtgggctagcctgtatccatccccctcccacctcccctcccaccacagtacctgtttctcttggaaggcaagttcccagttccagtggcagccagaattctttctatgctcttttagaaggtgggagatgcctgcctagactgttcagtggtcttaaaaaagagaccataaaattcatggttgcataaaatatagttttcatagatttaaattgcattttaaatgcactaaggcttcatctttgagcttttcagaaatgtgggatttcagactccatctttagggttgccttatttagcaaataaaaaacagtgtgccagttaagcatgagtatggcccttggaatgtttggggcataattataccaagacatcttattgtctttctgacatttagatttaactgggcatctcatgttttatctggcaaccctacccaccttgggtctactgaatccaaatctggattttcacaagatccccatggaattcgtgtgcgaattcaagtgtgagaagcattgcattgggagccttgccatcaaagccctgaatgaatcctttttgtaacaaatctgttggtaaaatataatg

SEQ ID NO: 1144 - DNA, 1343 bp, Homo sapiens
ccccacaataacttctcattaccttaattcacataaaggcatgaatgaatggtttccaacttattgctcttctggctgttttaattttctaaaagatgctgtttgctcaattaaattctgaccttttggatctcagggagccttataagctgaggtgatgattttatcattgaaaatatatgtatcatacctatgtcatatggaccaaaagtgaaattactagaaaaaaaaatgtgttgtatgatattaggagtgttgttcagttatttatagatttaaatagaaattttcaacttcaaaactattgacacttagggcaaggtgatgtttcattgtgtgtgcatgtttgtgtgaggaaatccatgtgttatatgtagcagagcctcagtttactagataccagtagtgcctcccagctgtaacaagtaaaactgtcttcaaatattgccaaatgtccattggtggcaaaatcatgcccagctgagaactactgatataaataattgctaccattttgagcaagtatgtgtgtgtatttaataaagggatataagaaaaaaatgtcgggaaatgtggggttatttaggagatgaccattctcctggtgcctctaaaattacaatccatgtaatagaaccaaatgcatttgtctaattcttatcctgtattctaataaaaggcagagattgaaactattagtttcatgtttaactctattatttaacttatcagataactaagatttggccatattttcaaaacagaaacagaaacacaatgttagagctgaaatgatcacggctgctgtttctcgaaatgtctgctccttaaagaccatggcccagagaaagaaagtctcacagaaatgcagtgacacagtaacgattagaatgcaggtctatgaccatctgttctccagtgaggaggaaacaacaaaagatactttcctcttggttagtagctcaccgacattacattttcctctggatttttgtgttatatacgttatatgtacctaaagccaccaagcagaagacgtgagcgtgactagagtctacgccaggtattcacatgacctaaaggtaaggctcaatttctctgcctcagtctcctcctctttaacatggggctaacaacacgaaattattgtgaagtactttgaaaactattacctgcaattaaaatgtgatttaccttattgtcatgctaaaacatttgagacatttatacaaatggtgactacatgcaagtttatctcagacagaaaagtgataatcccaatgctgtcagaactaaatttacaaggagtttatgctgttgctgtgataaggtgctaaaaatga

SEQ ID NO: 1145 - DNA, 6555 bp, Homo sapiens
tgtgaaacttaactgcgtattgttacttataaacacttcaattggatgaactcaaactgattattgaatctaaagacaacatcaatatggtgatcagcttctaagatggtccagcgatccctacctcatggtagttataccctggcatagtcccctcctgcattatatcagagttgatctgtgtgatcaatagaatatggcagaatagatgctatgccacttcaaatattgcattgtaaatggcactacaggttctatttgcattctgtctctctggctctgtctctcgggctctgtctctctgatcactcattctggggaaagtcatactgtaagaaaccttatggtggagagacccacatggtgagaaactgaggccttccaacaacaacgggggaatagaccctgcagccccagtcaggtcttcagagattgcagtccctgaaccagaatcacccaggctaagccatccccagatcccgaaatctcacaaactatatgagatgataaatatttgctattttaagctacatgaatactttggagacattatgggtttggttccagaccaccacaataaagcaaatagtgcaataaagcaactcatacaatctttttggtttctcagtgcataaaaaagttgggtttacactatactgtggtctattaagtgtgaaatagcattatgcctaaaaaacaaggtacatatttaatttaaaaatgctttatggttaaaaaatggtgaagatcaactgagacttcagtgaatcctaatctttttgctggtggagggttttgtcttgatgttgatgactgctgactgatcagggtggggtgatgattgctaaaggttggagtggctgtgacaatttttaaaaataaaacagtgaagttatccatatcaattgactgttcctttcactaaagatttatctaaagcatgctctctgtctctctctgtctctctttgatcactcactctggggaaagttatactgtttggtagtattgtaaccacagtagaactttttcaaaatgggactcaatcctctgaaaccctgtcaatactttgttaaagaagtttatgtaatattctaaatcctctgttgtcatttcaacaatgttcatggttgttgaccaagagtagattccatgtaaagaaaccactttccataagaagcaactcctcatctatttaaggtttatcaggagattgcagcagttcagtcacaacttcaagctccacttctaattctaattctcttgctatttccaccacatctgcagttgcttcctcaactgaagtcttgaaccccttaaaatcatccatgagggttggcatcaacttcttccaaacttgtgttaatttggatattttgaccttctcccatgaatcactaatgttcttactggcttctagaatagtgaatcctttccagaaggttttcaatttactttgcccagatccatctgaggaatcattgtctatggcagctttagccttctaaaatgtatttctttaataagaccagtaagtcaaaattactccttcatccatgggttacaggatggatattgtgttagcaggtataaaaacaatattaatattcttgtgcatctccatcagagctcctgggtcaccaggtgcattgtcaatgaacagtaatactttaaaaataatctttttgtttgagcagtaagtctcaaaagtgggcttaaaatattcatcatgccatgctgtaaacagatgtgctgtcattcacgctgtttggttccatttctagagcacaggcagagtagatgtagaataattcttaaggaccctaggatttttgagttagtaaatgagtattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttcttaagaataattcttaaggaccctaggatttttgagttagtaaataagtattgtcttcaacttaaagttaccagctgcgttatcccccttacaagagagtcaacctgtcttttgaagctttgaagccaggcattgacttttgctgtctagttacacaagtcctagaaagcatcttcctcaatataaagttgtttcacctacattaaaaatctgttgcttagtatagccactatcatcagtgattttatctagatcttctggataacttgatgcagtttctacatcggcacttgctgcctcaccttgcccttttatgttatgaaaatggcttctttccttaaacctcatgagccacaacctctgctagatgcaaacttttcttctgcagctctctcacctctctcagccttcatagaattgaagagagttacgccttgctctggactaggttttggcttaaggtaatgtcgtggctggtttgatagtctatccaaactactaaaactttcttcatattagtaataagcctattttgttttcttaacatttgtgtattcactggaatagtattttaatttccttcaagaacttttcttttgcattcagaacttggctaactgcttgttgcaagaagcctagctctcagcctgtcttggtttctgacatgccttcttcactatgcttaattatttctagattttgctttaatgctagagatgtacaattcttccttttacttgaacactcagaggccactgtagggttattcattgacctaatttcaatatttttgtgtctttgagaatagggaggcccattgagagggagagagatgaggaaatggcccatgagtggagaagtcagaacacacataccacttatcgatgaagttctcctactcatttgagtgtggttcatggcactccaaaacggttacaatagcaatctcaatgatctcaaagatcactgatgtgccaagtgcagcagcctcccagctacttgggagaccaaggtgggaggtttgcttgagcccaggagttgaagatcagcctgggcaatatagagagactctgtctccacaaaaacataaaatttgctgggtgtggtggcacgcatctgcagtcccagccactcaggaggctgaggtgggaagattgattgagccatgggaaagtcaaggctcagagagccatgatcatgctattgtgttccagcctgggcaacagagcaagaccctgtcaaaaagagagagagagaaagagaaagaaagaaagagagaaagaagaaagaaagaaagaaaaaaagaaagaaagaaagaaagaaaggagaaaggaaggaagaaggaagaaagagagagagagaaaaagaaagagaaggaaagaagaaagaaagaaaaggaaagaagaaagaaagaaggaaggaaggaaagagaaaggaaagaaagaaaaagaaagaaagaaagaaagaaagaaagaaagaaagaaagaaagaaagaaagaaagaaagaaagaaagagtcagggtcagtggctcaggcctataatcctaacaccttgggaggccaaggtgtgcagatcatgaggtcaggagttcaagaccatcctgaccaacatggtgaaaccagcctgcccaacatggtctctactaaaaataaaaaaattagccgggcatggtgggcgtgtgcctgtgatcccagctactcaggaggctgaggcaagggaatcacttgaacccaggaggtagaggttgcagtgagctgagatcacgccactgcactccagcctgggtgacagagcaagactctgtcaaaaaaaaaaaaaaaaaaaaaagaggaagaagaaaggaaggaagaaaagaaggaaggaaggagggaaggaaggacaatgaaaagaaaaaaaagaggaaaataatcactaatcacaaataaccataacagataaaatgataatgggaaagttctaaatataatgagaattaccaaaatgtgacacagagacacaaagtgagcatatggcattgaaaaaatggtgtcaatagacttgctcgacacagggttgccacaaacctttgatttgtttaaaaaaaaaaaaagcaatatctgtaaaatgctataaagtgaagtgaaataaaacaaggtaggcctgtactaaattttggtataatttgttaggcaaccaacagataatcgatgcaaacagttacagcttgaacctggcgagatgccatctcaatagggtttttatgtatgtgttacatggtaactttaaggctggaaaaggaaaaggaaaaagagaaataaactaaataatcagtgtagtaggatcaaagtgtttacttttaggctttcaaatcaaactacacagtgtggactagagtctactgatgcaatttctaaatcattgagactactaatcccaagcagccaataaaataatttgtcagtcaatctgtgaatttgtcagcatctcttttcactcttgttctccccagtcctcagctattttgaaaatcacatctcattggaagttgaaccagaaaaaagaagaacactgaagcttacatatgtgttctgctactctttgtggtttgtggtggaggctagttagactaaatttgaaagttggcaaaattgggcaccataatccttcttcaatcccctctctcttggtgctgagcattcttttttttttttttttttttttggacagagtctagtcctgttgcccaggctggagtacagtggcacaatcttggctcactgcaacctccacctcccaggttcaagtgattctccagcctcaacctccctagtagctgggtttacaggcacccaccagcaggcctgtggtgccgggcattcttatgctgtcttccacctgcctaaacccctcttctatggcatttacccaggactgcctttccccacaataacttctcattaccttaattcacataaaggcatgaatgaatggtttccaacttattgctcttctggctgttttaattttctaaaagatgctgtttgctcaattaaattctgaccttttggatctcagggagccttataagctgaggtgatgattttatcattgaaaatatatgtatcatacctatgtcatatggaccaaaagtgaaattactagaaaaaaaaatgtgttgtatgatattaggagtgttgttcagttatttatagatttaaatagaaattttcaacttcaaaactattgacacttagggcaaggtgatgtttcattgtgtgtgcatgtttgtgtgaggaaatccatgtgttatatgtagcagagcctcagtttactagataccagtagtgcctcccagctgtaacaagtaaaactgtcttcaaatattgccaaatgtccattggtggcaaaatcatgcccagctgagaactactgatataaataattgctaccattttgagcaagtatgtgtgtgtatttaataaagggatataagaaaaaaatgtcgggaaatgtggggttatttaggagatgaccattctcctggtgcctctaaaattacaatccatgtaatagaaccaaatgcatttgtctaattcttatcctgtattctaataaaaggcagagattgaaactattagtttcatgtttaactctattatttaacttatcagataactaagatttggccatattttcaaaacagaaacagaaacacaatgttagagctgaaatgatcacggctgctgtttctcgaaatgtctgctccttaaagaccatggcccagagaaagaaagtctcacagaaatgcagtgacacagtaacgattagaatgcaggtctatgaccatctgttctccagtgaggaggaaacaacaaaagatactttcctcttggttagtagctcaccgacattacattttcctctggatttttgtgttatatacgttatatgtacctaaagccaccaagcagaagacgtgagcgtgactagagtctacgccaggtattcacatgacctaaaggtaaggctcaatttctctgcctcagtctcctcctctttaacatggggctaacaacacgaaattattgtgaagtactttgaaaactattacctgcaattaaaatgtgatttaccttattgtcatgctaaaacatttgagacatttatacaaatggtgactacatgcaagtttatctcagacagaaaagtgataatcccaatgctgtcagaactaaatttacaaggagtttatgctgttgctgtgataaggtgctaaaaatga

SEQ ID NO: 1146 - DNA, 16016 bp, Homo sapiens
tgctgtttcctctaccataaatttatctacatcagagtccatcattacttctttccttcctatttatgagaaaaatataatcccccatttttatttctttttaatttggggaaaatgctaaaccagagaatatgcaaaatacacgtgattctcctttccaaggacagcaaatatgccctttatcaccttcttgccacccagtcctccaaccttctagacttaatttttcattccttctctcctcatttctccccctctggctatgagcacagttaaatctctggcatctttaaaacacaagtaaaatccaaactgtttatatatatatcccctatagaagaatctatggattaaaataaatttagattctaattctaacgagctagttttttttttttaattatgagataactggtgaattgaatactgactggatatttggtactagggaaccggtgtgtgtttgttaatggtattgcaattatgctctaaaaaggaacctttttttttttttttttgagatacatgctaatataaagatcaaatgatctggggtttgcttccaaaaaacacctagggttaaatggagggagtgattgggaacagatgaaatcagattgctggccaggcgcggtggctcacacctgtaatcctagcactttgggaggctgaggcgggtgaatcacctgaggtcaggagttcgagaccagcctgacccacagggtgaaacccctctctactaaaaatacaaaaattagccaggcatggtggcatgcgactgcagtcccagctactcgggaggctgagacaggagaattgcttgaatccaggaagcagaggttgcagtgagctgagatctcataaatgtatgtcatgagaacctatgcatacatttaaaacatgtagcataggttctcataatgtatgcataagcaacctatgcatacatttaaacatctgaatacaagatacggttcctccattctctgtttagtcctttgagaacaaggactgtgtctttctcttcactattcccagcaccatgtatctggcctgatacctaggtggtgcctaataaaggatgttgaatggagaaatgattgtaatttggaggggaaaaaattcatctggagataaaaatactggctggtattcttatgagtttttcttaaaagatgcaatctacaaattaagattcttctttttgcaacacctttgttctactgaattttatttactttttttgctgaatattaaaatattataatttaatattttttatttttttggaggcagggtctcactctgtcacccaggctggagtgcagtggagcgatcttggctcactgcagcctcaacctcctgggctcaagtgacctcagtctcccaagtatctgggactacaggcacacatcaccacacccagctaattttttgtatttttctgtagagacagggcttcgccgtgttgccaagactggttttattttattttattttttttgagatggagtcttgctctgtcgcccaggctggagtgcagtggcacaatttcggctcactgcaagctctgcctcccaggttcatgccattctcctgcctcagcctcctgagtagctgggactacaggcgcccgccaccatgcttggctaatttttttttttttttgtagttttagtagagatggggtttcaccatgttagccaggatggtctcgatctactgaccttgtcatctgcccacctctgcctcccaaagtgctgggattacaggtgtgagccaccacacccggccccataacttaaatgctcaggactattacactaatttagtttaatttatactaaactaaatcaacacattctaagaaataaatttgcctggtcagagtaggccaaaacaagagtaaaataaacaactattggctgggcatgatggctcacgcctgtaatcccagcattttgggaggctgaggtgggcagatcacctgaggtcaggagttcaagaccagcctggccaacatggtgaaaccccatctctactaaaaatacaaaaattagccgggtgttgtggcacaaacctataatcccagctactcatgaggctgagacaggagaatcgcttgaacccaggaggcagaggttgcagtgagccaagattgtgccattgcactcctgtctgggtgacaaaggtgaaactccgtctcaaaaaaaaaaaaaaaaaaaaaaaaagaagcaactattaacaattatgtcaggataatagacataataaaccagggctatcatatatctatgatgtgatatacaaaacaggaattccctttaaatgtcaataacttataatgaaccctatttctattttcacattctgttaaacaggttaagcaggttatatttatgaaagtatttaaattatgccagaaatttaaaagtttttggtttaaagccagaaaaatgatttacaagtagccataatcaaaatcaactgtggcagaaatcacatgtaaacattaaactgtattcatatccacgctcaattttcaatggcttcaaacccattctaccaattgactccaggcaactataggtaactgagattctagctctaaactgaagaagaaaaaccactttcccaagtacagcaaattatttaaggatatttaatatcctccttatagaagattattagaatcctaaaacattacaagaattaaggaaatttatgtccaaacattgtacttttttcttgtctttggttccctcagattctgacagatttcttcacacttgaataagaagtctgccagcagggtcagtgggtccttggaggggttttccactccctttttaccccttcctcctcctggcacccagctggacttgtggcccaatctcctaccccaaggcagcagagccacattcagccaggtagggattttgattttaatccctggtcctctcattcaacactcaaccttgggtacctttctttcctactctgcctcatttcctcttagtgtacaacaagggaggaaaggccaaatcatctgccagaactctcctagaagagagaaatctcaagccgggtgtggtggctcatgcctgtaatcccaccactttgggaggccgaggagggcaaactgcctgagctcacgagttcgagaccagcctgggcacaatgaaactgcatttctactaaaatacaaaaaagttagccaggcgtggtggtgggcgcctgtagtcccagttactcgggaggctgaggcaagagaattgcttgaacccgggaggcagaggttgcagtgagccaagatcgcaccactgcactccagcctgggcgacagagagagtctcaaaaaaaaaaaaaaagaaaagaaaaaagaaaaaaagaaaagaaaacaaaaatctctgcttctttgcattactaataggtaattaaaggctatgacaacaatacttgatgcagcaatttgctttctaccttgaaacatgcaataaatacacaagtctatgtcttttgtacccactggtcataaccatgacctattctttctttttttttttgtcatggagtttcactcttgttgcccaggctggagtgcagtggcacaatcttggctcactgcaacctctgcctcctgggttcaagcgattctcctgactcaggctcccaagtagctgggactacaggtgcccgccaccacgcccggctaattttttgtatttttagtagagatgggatttcgccatgttgggaaggctggttgacctattcttttttttttttttttttcttgagataggtagggtctcagctctgttgcccaggatggagtgcagtgttgtgatcataattcactgcagtctcaacctcctgggctcaagcgatcctcctgcctcaacatatggagtagctgggactgtgggcatgtgccaccatgccaggctaatttttgtagagacaggtctcactatgttgcccaggctggtctcgaactcctgggctcaagcaatctttctgcctcagcctcccaaagtcttgggattacaagcgttgagtcaccacgcccaacccataattgtgacctattctatagaaaggggtgttaacagtgtgtacaaacacataccaagtcatcagaagaggggtcaatccatgctctggcaggtgatcaattttcttttttttgagacagagtctcgctctgttgcccaggctggagtgcagtggcgcaatctcggctcactgcaacccccgcctcccaggttcaatcagttctctgcctcagcctccctagtacctgggattacaggtgcccgccaccatacccaactaatttttttgtatttttagtagagacagggtttcaccatgttggccaggctggtcttgaactcctgacctcattatccacctgccttggcctcccaaagtgctgagattataggcgtgagccactgcgcccggccgatcaattttcttaaaccaaatcaaataaggtgtcctttaactcagccactcagaattctacattaatccatttcagttggttgactaggtcaaactgcagtttttctttcactaatttggatgaatctaacataaaaaagacaacaatttaacgctatcttgagctgtaatcacttattcattcaactatcccttaagtacatatactacgtgccaggttccatttaggttctagggataaagcaataaaaaatcaccacccagctgggcacggtggctcacgcctgtaatcccagcactttgggagcctgaggcgggcagatcacctgaggtcaggagttcaacaccagcctggccaacatggtgaaaccccgtctctactaagaatacaaaaactagcccagtgtggtggtgtgcatctgtagtcccagctactcagaaggctgagacaggagaattgcttgaacccaggaggcgggggttgcagtgagccgagattgtcccactgcactccaacctgggcaacagagcaagactgcgtcccaaaaaaaaaaaaaaaaaaaaaaaagaatcaccacccatagagagcttacattcttggcaagcaacatcaacaacatagtaccaggaatgatgcggagtggggtaggtatcctgctctacttatgctggctaaactacatctggaaattgtattccattctaggcataggttaagaggtatgatatattagttatcaatttattgcctttcagttccaaatctatactttactgctctgctttgcaataatgaagctggactcttcaaatgtttttcttatgccaatagcaagcactggaggaatactacaggaggaagaggatttcctcctggttccactgtgttttcctcttctttctcccgtggcctcatgtgatgcgtgggacacccagcggtgctcacccaccagttttagggataccacaatgagtggcttcaggtgagttccagtcaccccagctaacttcccagtgattttcgacagcaccacccagagcagcttcctagacagttttgttggcactccagcaaacaatactcttgcttttaaccctcggctggtgccatcctcaggaacttaaaactgcaacagactacagctttacctcctcaaaaggtctgaatctccgccttgggtaggctctctctccaatctgtctctttctttcatactctgcctcaggcacagagggagtagctgctcctatagctgatacacctacatctttcagagttctctttaccctttaatggttaatctattactagttaataattctttatgttaactttcccttgttcaaattgcaatatttctgtttccagactgaaccctgatccagaactggtacaaaaagtagggtgatctcagaggacggacttaaaaacatgggatttagaaattggtttggtggcactcttgggtttaagtgcagtgctaagcaccttgccaatgggaaaggggatgctagtaatccaggacatgcaagatcgtggcaataatatactggcaaaaaccttcagaacatgtgtaggagtagatcatatagctggaggtggctctaacagttcacctcattggttgactgaaattttagactcgagtaaattatgtttaaaaaaaaaaaccaaaaacaaatttcagctgtggcacatgactgggcttggtggagtttcaagatgctgatgaatttaaggtctggcgcttgaaagaatcagtgaagcttttcaagtagatgagatatatttgaatatgtaacctttagtaactacagaatagaggttgctttttttgtttttttggtccctttcataggggtagcaggggtgaattctgaggtggccccaatcatctgtaggaatattcacctgacagtttcgtgtttctccccatagctgagttggtcttgtagaaaatttctacggaattcaattccattatttaaagtagcttttctatgaaccagctgtggtctgtaacttgacagtgttaataccaaatagcaagacctaatcatggttcacatactcaacaaatatataagactagtttttcaagtaggtcagttttggaacacattaattgtaactagattagctattttacaattaagacaactttataaactgctttaatttataaaggttttaaaattacattcttttgactctaaagattgttgttttacagcatattcttaaatactactgttgagccatatatatgacaatggtgaactttaatgaatatctgcacatctgtagtaaaatgcaatgctaccttcatttttttgttggtatgctgaagaaactttttaaagtatctcactttttaaaaaattggtcagaccctctccctctccctcctctccctcctctccctctccccacggtctccctctccctctctttccacggtctccctctgatgccgagccgaagctgggctgtactgctgccatctcggctcactgcaacctccctgcctgattctcctgtctcagcctgcctagtgcctgcgattgcagacgcgcgccgccacgcctgactggttttcgtatttttttggtggagacagggtttcgctgtgttggccgggctggtctccagctcctaaccgcgagtgatccgccagccttggcctcccgaggtgccgggattgcagacggagtctcgttcactcagtgctcaatgttgcccaggctggagtgcagtggcgtgatctcggctcgctacaacctccacctcccagccacctgccttggcctcccaaagtgccgagattgcagcctctgcccggcagccaccccgtctgggaagtgaggagcgtctctgcctggccgcccatcgtctgggatgtgaggagcccctctgcctggctgcccagtctggaaagtgaggagcgtctctgcccgcccgccatcccatctaggaagtgaggagcgcctcttcccggccgccatcccaactaggaagtgtggagcgtctctgcccggccgcccactgtctgagatgtggggagcgcctctgccccgccaccccgtctgggatgtgaggagcgcctctgcccggccgcgaccccgtctgggaggtgaggagcgtctctgcccggccgccccgtctgagaagtgaggagaccctccgcccggcagctgccccgtctgagaagtgaggagcccctccgcccggcagccaccccgtctgggaagtgaggagcccctccgcccagcagccaccccgtctgggaagtgaggagcatctccacccggcagccgccccgtccgggagggaggtgggggggtcagcccccccgcccggccagccgccccatccgggagggaggtgaggggcgcctctgcccggccgcccctactgggaagtgaggagcccctctgcccggccaccacccagtctgggaggtgtacccaacagctcattgagaacgggccatgatgacaatggcggttttgtggaatagaaaagggggaaaggtggggaaaagattgagaaatcggatggttgctgtgtctgtgtagaaagaagtagacatgggagacttcattttgttctgtactaagaaaaattcttctgccttgggatcctgttgatctatgaccttacccccaaccctgtgctctctgaaacatgtgctgtgtccactcagggttaaatggaaaaaataaataaataaattaaaaaaaaaataaaaataaaaataaaaataaaaaattggtcagatcgcgagatcaggagttcgagaccagcctggccaatatggtgaaactctgtctctactaaaaaatacaaaaattggtcgggtgtggtggcatgagcctgtagtcccaactactcgggaggctgaggcagaaaaattgcttgaactttggaggcagaggttgtagtgagccgagatcgcaccattacactctagcctgagtgacagagcaagactccatctcaaaaaataaataaaatacaaaaaaaaaattggtttgtgtattttatatgcttacatatttttccatggtactgtaggtcattttagtgattaaatttgacacttttgacagaaaaacaggtcaattagttccttgggatcaaaaaggggttgattgcaaaggggcaggagggaattgatagagtgattttacaatggttctgcatcttgagtatggtatgactatgcatttgtcaaatcttagggtgaactttactgaatgtaaattcatgcttcaataaacaggactttaaaaacttacaaaaaaaaacacaaaacaacaacaaaaggactgggtgcagttcacacctgtaatctcagcaggggggccaaggtaggaggcttgagcccaggagttcaagcctagaatgagcaacacacagagaccccatctccacaaaaaataaaaaattaaccaggcacagtgtcacatgcctgtaatcccagctactcaggaggctgaggaaggaggactacttgagcctaggagttcgaaattacagtgagctatgatcacgccactgcactccagcctgagtgaccgagtgagagcctgtctctaaataaataaataaaactttctttaaaaaagagtccactatgtttaatgaggtggagatgccaaagtttccctagcaagatgtagaagaggcaattcaaaaacttagggagatagaaatgttggaatggatttttcatgtgtaacctatgttgcaaaaaaaagctcggaagataatcctttcactcaggcattgagaaatccattagtgaggtgggcatggtggttcacacctgtaatcccagtactttgggaggccgagccaggtggatcacttgaggccaggagttcaagaccagcctggccaacatggtgaaaccccgactgtactaaaaatacaaaaattagccaggtgtggtggtgcacaactgtaatcccagctacttgggaggctgaggcatgagaattgcttgaacccaggaggcagaggttgcagttagccaagatcgtgccactgtactccagcctgggtgacagagtgagactctgtctcaaaaaaacaaaaaaaaaaacaaacaacaacaaaaaaagaaatgcattagtgaggggatcaccttcatccttgaaaagctctgtggttgctcccctttgcagtgtgtccctgttcccctagacatgggttggcaaactttatttataaagggccacagataaacattttaggttttacagtccctaaggtctctgtcacaacccctaggtatggccatgggaaatgccaccactaagtgggttccctgatttaaaggggtaacgggatcctaaaataacagaggccaagtagcagcatgtaatcaccaaagacaaggtgggaaatctactataaatacagtaaagttgtactggtaatcagaacaccttggcccaccaggatctttggcagtaattgatcacacagtattccacaagcagcctaccaaaacagattcatctgtacaactgaaaaaaactccagctctggtagtaaaaacctgactagaaaagttttgacctctcatctaatttctagacccaagtcaattaacaagcccaggtcccctgaggaaaaacctgtagtgttcccacaagtacaagtacatactgtaaatcctcatccaagcttccccaaaggccatttactagagtgactacggattagagaaaaggaaatacccagacctttcagggattactaattcctggggactcaaaatgctactgtggcctatcagtcaaagtgagtgctgacagtggtcaggtaatagatgaaatgcttagctcaagtccacctcacagtggaccccatagtacaatgggcctactttgttgttatctcctcagttcctgaataaatacttggaacagacatacttgactattggcagagctcccatattggctttctgacccaactgataagagtcattttaatagtaagggctaaatggaagcccctagaacttaccctccctactaagatattaagccagaagcaataccacatctcaagaattaaagagcttaatgtcaccatcaaaagacttgaaagaaacagggtagtgatacctattatatcttgatttaactcgccagtttgtcctgtgcagaagtcagatggatcttagtgactatcataaactcgtggactatcataaacttaatctggtgatgattccaattgcagctgatgccccagatatagcatctttactggagcaaatcaacatgggtcacggcacttggtatactgctattaacctgaataatgcctttttcttcatacaaatctgcaagaaccaccagaagcacattgcttttacctgccttttacgtgcctatgaatctagcctcagggctatgccattctcctaccataatgtagcccacagagatcttgatcgcgtgacattccaaaaaaataaataaataagcacgtacacacacacacacacacacacacacacacacacacacacacacactagtcaactatactgacattatgctaattgggtctgataaatagcaagtagcaaatacgttagatgctttagtaagacatatacaaagtagttgatgcgagataaaccctacaaaaattcagagacccactgcagcaatgaaatgtcaggattcaattgctcaaaacatgtcaaaatttcccttccaaggtgattaagttgctctaattaacatcaccaacaatgaaaaagagggtacaatgtttggtaggcttcaacccagctacaaagttacctacaaggttgacagtttagagtgggtttcagagcaagaaaagattctatagcaagttcaagctgtggttcaagctgctctgccatttgggccttatgatctggcagatccaatgatacttgaagtgtccatggcaaatagggatgctgaatggagcctttagcaagcaagaataagagaatcactgcccagacttctagaattttgagaaaatctatgccctcttttgcagaaaattattcacctttcaaaaaatagtttcaggcttgctattgggtcttggcagagaccaaatgcctaaccatgggacataatgcaaccacgtgtcctgagcttctcatcaggaactagatgttatccaacctatgtagtctagcttggcatgtgcagcacgatctatcatcaagtgaaaaacacgtaaaaaaaaaaattcaagcaggtccagaaatatgagtaagttacataggaggtagctcagacttcagcattgagttctgttgcattgcttcctctccctcaatccaagtcaatggcctcctgagagctccatatgaccagctgactggggaaagaaaaaactcaagtctggtttacacatagctctgcacaacatgccagtatcacccaaaagtggggagctgcagcactacagccccatttaaagaggtaggactgaagggcagtgatgaagaaaaatctttccttcagagggcagaacgttgaggggtacatttggttttcccttttgcctgaggtaagacatggccagaagcagagatttatactcatttatgaacaattattaaggattttgttggctagttaggaacttggaaggaaatggtgacaaggaaatctgggggaaagatatgcagatgaaactctcagaacaggcacagactgtgaagatatttgtgtcccatgtgaataatcatttgcattcactgtagaggaggctcttaataagcaagttgacaaaatgacgtacttcatgaatataaatgttagacactttccatagctacaagagtgcttgctcaataaaacccatggaaaaaatcatcatgaaggctgtgcatggactcaacaacatgatcttcccctaaacagggctgacctgactaaagctactgctaaatgtctaatctgttaatggcacagactaactctgagccctgaatatgcaccatttcccaaaaactagctaaccacctggtggcaagttgattacgctggacttctattatggggaataagggcaggggtgagggaagagatttgtcctcactagaatagacatgtattctggatacagatttgccttctctgcctataatgtttttggcagttccaccacccatgaacttatatataagtgcccaatctaccaccatgacattccacacagtgttgcggctgcttctttttttgagatgaggtctccctctgtcgcccagtctggagtgcagtggcacgatcttgtctcactgaaacctctgccttctgggttcaagtgattctcccgcctcagcctcccaagtagctgggactacaggcatgtgccaccatgcccggctaattttttttgaatttttagtagagatggggtttcaccatgttagccaggctggtctcgaactcctaacctcaggcaatctgcccgcctcagcctcccaaagtgctgggattacaggtgtgagccaccatgcttggccaaaaaaaaagatgtatttttaaaatagagacaaggtctcactatgttacccaggctggtctcaaactccttggctcaagtgatcctcctgccttggcctcccaaaatgctggggttacaggcatatgccaccatgccaagcccacacagcattgctcctgaccaagaaagtcatttcatagtaaagaaatgcagaaatgggctcatgtccatggacttaactggtgttgtcacatcctatcacacagaatggttggcctaattaaaatagggaattgattactgaagactaagttacagtttcagggagacaacaccctgaaaggatggggtaatgatttcaatcagagacaccttacatggtgctgtctcctccctcaatcagaatatacaggtctgggaatcaaagggtagaagtatgtgcggctccactcactattatatctagcaatcactgaatttttgctttcactcctaacaactgagttctgctggcttggaagtgctagtccctaagcaggaaatatatctactagcatacacaacaatggttcaattgcattagaagatgagactgccacttggctacttgggactccttacaccactgaaccaacaggctgaacctactggttgggaaagattgagcccaattgtcaaggggaaacggttgctgctacacagtgaaagcaaggaggactatgtctgaaacccaagggattatctaaggcacctcttaatacttccatgccaaaaataaagattaatggaaaactacagcaaccaaaaaaggactggactaatgagggaataaatgtttgagtcatttcaccaggtaaagaacctcaaccagctgaggttcgtgctgaaggcaagggaaacatgaaataggtaactgaagaaagaagcctagatatcaactgtggcctcattactaatcacagaaatgaggatgaactttctctttgttatatttggtatttgtttgtatattctaaccattttcttctttccttcttcccattattataagttggaattagttcagtttagttttgtttttttgagaccgagtctcactctgttgcccaggctggagtgcagtggtgcgatcttgactcactgcaacctccgcctcccagcttcaagtgattctcttgcctcagcctcctgagtagctgggattccaggggtgtgcaccacacccggctaattttttttttttttttttttgagaccaagtctcactctgtcatcaggatggagtgcagcggcaagatctcggctcactgcaacctccgcctcccaggttcaagcaattctcctgcctcagcctcccaagtagctgggtctataggcgtgcaccaccacacctggctaatttttgtatttttagtagagacggggtttcaccatgttggccaggatggtcttgatctcttgacctcgtgatccacccaactcggcctcccaaagtgctgaaattacaggcatgagccaccgcacccgccttgaaattagatttataatacaacttttggtaacaaactagtcagtggaactttgttttctgccacatgaaaatctttaaagcttatgctgacgcatatctgaatgcttgtcatcaaagtgtgcagtaaaaaaaaaaaaggcagtttaagaaaatttgagcatttcaaagaaagcacttttaaaaatgtatatacatgaaggtggccgggtgtggtaactcacacacctgtaatcccagcacttttggaggccaagcgggtggatcacctgaggtcaggagttcgagactagcctggagaacccccgtctctactaaaaatataaaaatcagccgagcgtggtagcacacacctgtggtcccagctacttgggaggctgagaggcaggagaatcgcttgaatctgggaggcggtggttgcagtgagccaagattgtgccactgcactccagcctgggcaaaagagcgattttcaagggaaaaaaaaaaaaatgtggctgggcgcagtggctcacgtctgtaatcccagcactttgggaggccgaggtgggcagatcacaaggtcaggagatcgagaccatcctggctaacacggtgaaaccccgtctctactaaaaatacaaaaagaaattagccggacgtggtggcgggagcctgtagtcccagctactcaggaggctgaggcaggagcatggcgtgaacccgggaggtggagcatgcagtgagccaagatcgcgccgctgcactccaccctgggcgacagagcgagactccatctcaaaaaaaaaaaaaaaaatgtatatacatgaagaacattttgctatatcatgaaataaatgtagcgctgtaagataaaggaagatgaatataaatggagttttggccatttttatttttttttgagatgaagtcttgttctgttgcccaggctggagtgcagtggtgcaatcttggttcaatgaaacctctgcctcctgggttcaagcaattctcctgcctcagcctcccaagtaactgggattacaggcactcaccaccatgcccagctaactttttgtatttttagtagagacagggtttcatcatgttggccgggctggtcttgaacttgggatctcaagtgatccgcctgcctcgcctcccaaagtgctgggattacaggtgtgagccaccatgcccgggcagagttatgcccattttgcccctccacatgctgcagccatctttaacctgtttaacttaatgattatagttttgtttttcttttttcatcttattcagtatatttcaggctattcagcagatgcttgtgattctggaggttcaaatcactggtaaaagtttattctgtttcctcagtttttcaggagcttttctccattaaatgatctgctgcctaaagtaccctctgtcttcctcatcaacaggcgctaaattcaaaaagtaccttactgaaacttttttgttcataactttcattgttgg

SEQ ID NO: 1147 - DNA, 22982 bp, Homo sapiens
gttcttgaatcacaaaacacaaatgtaataaaacaaccccattctggattactgcagtgaaattaatcagaaaattataggagaaagatgtttctgatgttctcaggttgaaggtaggaatcaatctcagaacctttggctaccttcaagaacagcttttcctttttcttcttcttttttttttttttttttttttgagacgaagtctcactcttgtcccccaggctggagcgcgatagcacaatctcagctcactgcaacctctgcctcccgggttcaagcgattctcctgcctcagcctcctgagtagctgggattacaggcgcctgccaccatgcccggctaatttttgtatttttagtagagacgaggtttcaccatgttggccaggatggtctcgaactcctgacctcaggtgatccgcccgcctcagtctcccaaagtgctgggattacaggcatgaaccactgcacccagccatttttcttcttttattattattattaaatattctaaaaaatctatagagggaaaggagggagagaacagctgggcaccagcagacatatttgagttcttacttttattttattgagacaagatctctgctgggtgtggtggctcatgcctgtaatcccagcactttgggaaggcagaggcaggcagatcacttgaggtcaggagttagagaccagcctggccaacatgatgaaacgctgtctctactaaaaatacaaaaattagccacgcatggtggcgcacacctgtaatcctactcgggaggctgagacaggagaattgtttgaacctgggaggtggaggttgcagtgaaccgagactgtgccactgcacccagcctgggcgacagagcgagattctgtctcaaaggaaaaaaagaaaaaagggaattgttaattgagacaaggtctgactgtctcccaggtatagtggcgcaatcacagctcactgcggcctcaacttcctgggctcaagcaatcctcccctctcagcttctccagtagctaaggacacagatgtgtgccactatgcccttctaatttattattgttattattttgggggtagagacagggtctccatacattgcccaggctggcgttgaacaactgggctcaagcaatcctccggatttgacctcccaaagtgctaggattacatgcatgagcctctataccaggcccatatttgagttcttaaccctggctttgccacaggctaaccatgtaaatttgggacagccctttcatctctcttagtcacagtaatgacctctaaggatacttgttcagttctaaaattatggttaagtaaaaaacattcttcaagtcacatcctatttagagaaggtgcacctatccatctatttcaaagcttataaagacgatgtgtttagggcttcaacaacacaaaacattattacggcaaatgttagatgctaatctaaagccttccttacccatcaaatgaacccatcccaggcttgttccctactactccaacaggaaagtcatgcagtaagtatgctgtcccctcatggctcctgctagagcctgtgctccactctgcccctgtgcctttgctcatgagatcactgatcccctgcttgaaatgtctcctccctgatccaattccaaagccaccacttgggcctcatagcttccacagaacctctctgatgactttaatgctcattttccactacttagctcttttaccattcactgttactaggaaagaatttagtccttaagcacatgttttcctgttagtctttttttaaaaaattaaaaagcctttaagtattctatttatcattaaaattttcattattttacatgttagtaagtgaactcattaatgtttaaaaagaaaatactgtgcttttactacttttatttcctcacaatgcctagctaactgcatgagacagaatagtattcaataaataagttgctatcaaattatcacaagatcattatttgggctaaatgatgtaagttaaattcacattatacaccaaacttcttggaaagtgatttgcatttattataaagagcataaggttggtgacataatgtttttttttaaaaaagcataaggaattccaaaataatttaaacaatagcctatcatttctaagatagacattaaaaactctgattctgcttatatttcttactcatggtaagaaactgtaaagaaatagttttttttttttttttaaacaaccacctcttgatcaaaaaataagtttttaatcagagaaatgggtacattttcctcacccctcctggagaaggagcatgaaagtctgttttttgttgttgttgtttttttcatttttttaaaaatttttttgaggtggagtctcactctgttgcctaggctggagtgcagtggcatgatctccactcactgcaacctcccaggttcaagcaattctcctgcctcagcctctcgagtagctgggattacagatgtgcaccaccatgcctggctaatttttgtacttttagtggagacgaggtttcaccatgttggtcaggctggtctcaaactcctgacctcaggtgagccacccgccttggcctcccaaaatgctgcaattataggtgtgagccaccacacctggcccaaatctggttttaagatgcagaattttgctggttattcccttccacagggtgcagcacagcctggagcagctatctcaacagcaaagttcagaatcaccagtcccccgccaccattattattaaggagcatgtttgaccagaggctcactcccacatctttattcaatactgctgacctagattttgttcttaaaactacacagcagaagcaggcaaactcccctgtagaaacaacagccttcagaataaattttttagcatacttgcaatctactcagagagtctatttcagtaaaactatggaaaatgaaattctaaacaagaagcaatttacataatgcagtagaaaaaatacttaccactaccactggccatccctagagactttgattctcctataaaagtagaatggggaaggacaggggacagttttctatctctgtgaaattgaaggcatttaacagaaaaggcatatggctaaacacttaaagtactaattaaacaagtagcatatctacatatcaaaactagactaattctgtcacatatgatccattccaagtgcaagatagactaatggattttaaataacagtacaaaaagttcattgatatggtttcagattccccattgcaaacaacctttaagaaactaccacttggctaggtgcagtagttcacccctgtaaaccacagcactttgggaggctgaggtgggagaactgcttgagaccaggaatatttttttcatttttggagacagagttttgctcttgctgcccaggctggagtgcaatggtgcaatctcggctcactgtaacctctacctcccgggttcaagcaactctcctgcctcagcctcccaggtagctgggattacaggcagccaccaccacacttggctaattttttgtatttttagtagagacggggttttaccatgctggccaagctggtctcaaactcctgatctcaggtgatccacccacctcggcctcccaaagtcctgggattacagcgcctggccagagcccaggaatttgagatcagcctgggcaacataatgagaccctatctctaccaaaaaaaaaaaaaaaaaaaaaaaaaaaggaagaagaagaagaaaagaaactaccatttgtgaagttttgatgtcaaatcaaatacccatagttacctggaaaaaaaactgtcaaaatattcctcctcctaactacatatttgtgtgaaatggattttcttcatatactgcaacccaaacaacatattgtgacagactgaatgcagaggcagatataaaaatacagctgtgttctattaagacagacattaaaaagatttttaaaagcgaaaccatggctgggctcggtggctcacgcctgtaatcccagcactttgggaggccgaggtgggcggatcaagaggtcaggagttcgagaccagcctggctaacatagtaaaacacagtctctactaaaaaaacaaaaacaaaaaaaaaaaaaactgggcatggtggcgtgtgcctgtaatcccagctactcaggaggttgaggcaggaggactgtttgaacccgggaggcagaggttgcaatgagctgagatcgtgccattgcactccagcctgggcaacagggcaagactccgtctcaaaaaaaaaaaaaaaaaggcgaaaacgctaccactgttcttactaatctccttcatttttgaaactatacttctcaataaaaatattgtttattattactttttaaaatgagataagtatttttcaggtttctccagttttagtttgataaatagatataaccctcacaaacacaagctctttgggggtctttactaagggctgtgctagtatttggtctctaaactcctttacagttttagaagtctgttagtccaaatccctatatactccagtgcaagctcacacttctagcctcctacagccccgttcttccctctccccattccctgcagaaagtcaagaaatccaagacaaagttcaggcttcattatgcttttgggatagaagcttagccatgtgagaaatgaaaaaatacacaacacagtatctcattaagagctaaacttaatcataaagacgttaaaatggcataacaataaaaattaagaaaaattaatgctggcaaaggtgcttcacagaaaagaaaggggaaaatgtctgaatgtggtattttcatttactactgacagttttttttaaattaaaaacttttttttctatttatttttagagatggggtctcactttgttgcctaggctggagtgcagtagctattcacaggcataattatagctcactgcagccttgactgagctcctggccccaagtgattctcccacatcagcttcccatgtagcagggactacaggtacatgccactgtgccctgacaatcaccactgtttttgttttttgttttttgcttttttcatgcacacagggataccagttactgttgacattgtaagtaacacatgtgagaacatcttagattattagatcaaacaaaggtgacaaggaaaatacgtgtatattcatatacatacatatcttacagaatgctaaaatagttgtggtaaaatcgtattgattgttgaatctggaaaaatgtataaagttctttcaacttttctataaatttgaaattatttcaaaataagctgggcatggcggctcacacctgtaatcatcgcaatttgggaggtggaggcaggaggatcgcctgagcccaggcattggagaccagcttgggcaatgtagcaagaccccaacctctacaaaaaaaatttaaaaaattagccaggcacggtagtgcacacctgtcgtcccagttactttggaggctgaggtgggaggattgcttgagccaggatttcaagattgcagtgagctatgatagaaccactgtattcctgggcaacagaccaagaccctgtctccaaaaacacaaaagaaaaaaaactttcaaaataaaaataaaagtatttcaataaaaaaagtgacaggagaaagcctactcctttctcagattttcagccgactccattttttataattaaatagatccaaatgttcatatccaactatattagcgtccttctccactgtattaaactagcaaaaagcccactaacctttcttgatttaaaataatattttaggccagatgcggtggctcatgcctgtaatcccagcactttgggaggctgaggcccacagatgacatgaggtcaagagttcaagaccagtctgacccatgtggtgaaaccccatctctactaaaaatacaaaaattagccaggcgtgatggtgcatgtctgtaatcacagccactgagactgaggcagaagaattgcttgaactcgggaggcagagggtgcagtgagcccagatcccgtactgcattccagcctaggtgacaaaacaggactctttcccccactctccccaaaaaaggcttcaaacccatctcaattaaaaaaacaaaaataaattaatgatatttgacatccctacaatggttggaagactctgagtttagccctctagcaatatttgaaaacaccaaggcatttgaaggaaatctccagcaggaaggagataactttaagatcacatagcacacttgttttgcttcaaccagaaattctgctggatgtgtctcagagtggccacaggtgaaggatgctaccctgagaccacaatacaggctaagttggcagtagctgagctgtcaactcagaatactgaatagtttcagtattctacctcctacaacacttgatttattatcatactgaatgtacttgttcctataaacacacctctctacacaacttcctataaaaacatgtgtccctggcaaggcgtggtggctcacgcctgtaatctcagcactttgggaggctgaggcaggtggatcacaaggtcaggagatcaagaacagcctgatcaacatggtgaaaccctgtctctactaaaaatacaaaaattagctgggtgtggtggcacacgcctgtaatcccagctaatcaggaggctgaggcagaagaatggcttgaacctgggaggcggaggttgcagtgagccaagatcacgtcactgcactccagcctgggcgagagagcaaaactctgtctcaaaaacaaaaacaaaaacaaaatgtgtccccatgcaacttcctttctcattctccacagtctgttatacatactttcttttccagctcactccatccaaaatatagtattttactttatagaaaatgatattatatgactgctgtttcctctaccataaatttatctacatcagagtccatcattacttctttccttcctatttatgagaaaaatataatcccccatttttatttctttttaatttggggaaaatgctaaaccagagaatatgcaaaatacacgtgattctcctttccaaggacagcaaatatgccctttatcaccttcttgccacccagtcctccaaccttctagacttaatttttcattccttctctcctcatttctccccctctggctatgagcacagttaaatctctggcatctttaaaacacaagtaaaatccaaactgtttatatatatatcccctatagaagaatctatggattaaaataaatttagattctaattctaacgagctagttttttttttttaattatgagataactggtgaattgaatactgactggatatttggtactagggaaccggtgtgtgtttgttaatggtattgcaattatgctctaaaaaggaacctttttttttttttttttgagatacatgctaatataaagatcaaatgatctggggtttgcttccaaaaaacacctagggttaaatggagggagtgattgggaacagatgaaatcagattgctggccaggcgcggtggctcacacctgtaatcctagcactttgggaggctgaggcgggtgaatcacctgaggtcaggagttcgagaccagcctgacccacagggtgaaacccctctctactaaaaatacaaaaattagccaggcatggtggcatgcgactgcagtcccagctactcgggaggctgagacaggagaattgcttgaatccaggaagcagaggttgcagtgagctgagatctcataaatgtatgtcatgagaacctatgcatacatttaaaacatgtagcataggttctcataatgtatgcataagcaacctatgcatacatttaaacatctgaatacaagatacggttcctccattctctgtttagtcctttgagaacaaggactgtgtctttctcttcactattcccagcaccatgtatctggcctgatacctaggtggtgcctaataaaggatgttgaatggagaaatgattgtaatttggaggggaaaaaattcatctggagataaaaatactggctggtattcttatgagtttttcttaaaagatgcaatctacaaattaagattcttctttttgcaacacctttgttctactgaattttatttactttttttgctgaatattaaaatattataatttaatattttttatttttttggaggcagggtctcactctgtcacccaggctggagtgcagtggagcgatcttggctcactgcagcctcaacctcctgggctcaagtgacctcagtctcccaagtatctgggactacaggcacacatcaccacacccagctaattttttgtatttttctgtagagacagggcttcgccgtgttgccaagactggttttattttattttattttttttgagatggagtcttgctctgtcgcccaggctggagtgcagtggcacaatttcggctcactgcaagctctgcctcccaggttcatgccattctcctgcctcagcctcctgagtagctgggactacaggcgcccgccaccatgcttggctaatttttttttttttttgtagttttagtagagatggggtttcaccatgttagccaggatggtctcgatctactgaccttgtcatctgcccacctctgcctcccaaagtgctgggattacaggtgtgagccaccacacccggccccataacttaaatgctcaggactattacactaatttagtttaatttatactaaactaaatcaacacattctaagaaataaatttgcctggtcagagtaggccaaaacaagagtaaaataaacaactattggctgggcatgatggctcacgcctgtaatcccagcattttgggaggctgaggtgggcagatcacctgaggtcaggagttcaagaccagcctggccaacatggtgaaaccccatctctactaaaaatacaaaaattagccgggtgttgtggcacaaacctataatcccagctactcatgaggctgagacaggagaatcgcttgaacccaggaggcagaggttgcagtgagccaagattgtgccattgcactcctgtctgggtgacaaaggtgaaactccgtctcaaaaaaaaaaaaaaaaaaaaaaaaagaagcaactattaacaattatgtcaggataatagacataataaaccagggctatcatatatctatgatgtgatatacaaaacaggaattccctttaaatgtcaataacttataatgaaccctatttctattttcacattctgttaaacaggttaagcaggttatatttatgaaagtatttaaattatgccagaaatttaaaagtttttggtttaaagccagaaaaatgatttacaagtagccataatcaaaatcaactgtggcagaaatcacatgtaaacattaaactgtattcatatccacgctcaattttcaatggcttcaaacccattctaccaattgactccaggcaactataggtaactgagattctagctctaaactgaagaagaaaaaccactttcccaagtacagcaaattatttaaggatatttaatatcctccttatagaagattattagaatcctaaaacattacaagaattaaggaaatttatgtccaaacattgtacttttttcttgtctttggttccctcagattctgacagatttcttcacacttgaataagaagtctgccagcagggtcagtgggtccttggaggggttttccactccctttttaccccttcctcctcctggcacccagctggacttgtggcccaatctcctaccccaaggcagcagagccacattcagccaggtagggattttgattttaatccctggtcctctcattcaacactcaaccttgggtacctttctttcctactctgcctcatttcctcttagtgtacaacaagggaggaaaggccaaatcatctgccagaactctcctagaagagagaaatctcaagccgggtgtggtggctcatgcctgtaatcccaccactttgggaggccgaggagggcaaactgcctgagctcacgagttcgagaccagcctgggcacaatgaaactgcatttctactaaaatacaaaaaagttagccaggcgtggtggtgggcgcctgtagtcccagttactcgggaggctgaggcaagagaattgcttgaacccgggaggcagaggttgcagtgagccaagatcgcaccactgcactccagcctgggcgacagagagagtctcaaaaaaaaaaaaaaagaaaagaaaaaagaaaaaaagaaaagaaaacaaaaatctctgcttctttgcattactaataggtaattaaaggctatgacaacaatacttgatgcagcaatttgctttctaccttgaaacatgcaataaatacacaagtctatgtcttttgtacccactggtcataaccatgacctattctttctttttttttttgtcatggagtttcactcttgttgcccaggctggagtgcagtggcacaatcttggctcactgcaacctctgcctcctgggttcaagcgattctcctgactcaggctcccaagtagctgggactacaggtgcccgccaccacgcccggctaattttttgtatttttagtagagatgggatttcgccatgttgggaaggctggttgacctattcttttttttttttttttttcttgagataggtagggtctcagctctgttgcccaggatggagtgcagtgttgtgatcataattcactgcagtctcaacctcctgggctcaagcgatcctcctgcctcaacatatggagtagctgggactgtgggcatgtgccaccatgccaggctaatttttgtagagacaggtctcactatgttgcccaggctggtctcgaactcctgggctcaagcaatctttctgcctcagcctcccaaagtcttgggattacaagcgttgagtcaccacgcccaacccataattgtgacctattctatagaaaggggtgttaacagtgtgtacaaacacataccaagtcatcagaagaggggtcaatccatgctctggcaggtgatcaattttcttttttttgagacagagtctcgctctgttgcccaggctggagtgcagtggcgcaatctcggctcactgcaacccccgcctcccaggttcaatcagttctctgcctcagcctccctagtacctgggattacaggtgcccgccaccatacccaactaatttttttgtatttttagtagagacagggtttcaccatgttggccaggctggtcttgaactcctgacctcattatccacctgccttggcctcccaaagtgctgagattataggcgtgagccactgcgcccggccgatcaattttcttaaaccaaatcaaataaggtgtcctttaactcagccactcagaattctacattaatccatttcagttggttgactaggtcaaactgcagtttttctttcactaatttggatgaatctaacataaaaaagacaacaatttaacgctatcttgagctgtaatcacttattcattcaactatcccttaagtacatatactacgtgccaggttccatttaggttctagggataaagcaataaaaaatcaccacccagctgggcacggtggctcacgcctgtaatcccagcactttgggagcctgaggcgggcagatcacctgaggtcaggagttcaacaccagcctggccaacatggtgaaaccccgtctctactaagaatacaaaaactagcccagtgtggtggtgtgcatctgtagtcccagctactcagaaggctgagacaggagaattgcttgaacccaggaggcgggggttgcagtgagccgagattgtcccactgcactccaacctgggcaacagagcaagactgcgtcccaaaaaaaaaaaaaaaaaaaaaaaagaatcaccacccatagagagcttacattcttggcaagcaacatcaacaacatagtaccaggaatgatgcggagtggggtaggtatcctgctctacttatgctggctaaactacatctggaaattgtattccattctaggcataggttaagaggtatgatatattagttatcaatttattgcctttcagttccaaatctatactttactgctctgctttgcaataatgaagctggactcttcaaatgtttttcttatgccaatagcaagcactggaggaatactacaggaggaagaggatttcctcctggttccactgtgttttcctcttctttctcccgtggcctcatgtgatgcgtgggacacccagcggtgctcacccaccagttttagggataccacaatgagtggcttcaggtgagttccagtcaccccagctaacttcccagtgattttcgacagcaccacccagagcagcttcctagacagttttgttggcactccagcaaacaatactcttgcttttaaccctcggctggtgccatcctcaggaacttaaaactgcaacagactacagctttacctcctcaaaaggtctgaatctccgccttgggtaggctctctctccaatctgtctctttctttcatactctgcctcaggcacagagggagtagctgctcctatagctgatacacctacatctttcagagttctctttaccctttaatggttaatctattactagttaataattctttatgttaactttcccttgttcaaattgcaatatttctgtttccagactgaaccctgatccagaactggtacaaaaagtagggtgatctcagaggacggacttaaaaacatgggatttagaaattggtttggtggcactcttgggtttaagtgcagtgctaagcaccttgccaatgggaaaggggatgctagtaatccaggacatgcaagatcgtggcaataatatactggcaaaaaccttcagaacatgtgtaggagtagatcatatagctggaggtggctctaacagttcacctcattggttgactgaaattttagactcgagtaaattatgtttaaaaaaaaaaaccaaaaacaaatttcagctgtggcacatgactgggcttggtggagtttcaagatgctgatgaatttaaggtctggcgcttgaaagaatcagtgaagcttttcaagtagatgagatatatttgaatatgtaacctttagtaactacagaatagaggttgctttttttgtttttttggtccctttcataggggtagcaggggtgaattctgaggtggccccaatcatctgtaggaatattcacctgacagtttcgtgtttctccccatagctgagttggtcttgtagaaaatttctacggaattcaattccattatttaaagtagcttttctatgaaccagctgtggtctgtaacttgacagtgttaataccaaatagcaagacctaatcatggttcacatactcaacaaatatataagactagtttttcaagtaggtcagttttggaacacattaattgtaactagattagctattttacaattaagacaactttataaactgctttaatttataaaggttttaaaattacattcttttgactctaaagattgttgttttacagcatattcttaaatactactgttgagccatatatatgacaatggtgaactttaatgaatatctgcacatctgtagtaaaatgcaatgctaccttcatttttttgttggtatgctgaagaaactttttaaagtatctcactttttaaaaaattggtcagaccctctccctctccctcctctccctcctctccctctccccacggtctccctctccctctctttccacggtctccctctgatgccgagccgaagctgggctgtactgctgccatctcggctcactgcaacctccctgcctgattctcctgtctcagcctgcctagtgcctgcgattgcagacgcgcgccgccacgcctgactggttttcgtatttttttggtggagacagggtttcgctgtgttggccgggctggtctccagctcctaaccgcgagtgatccgccagccttggcctcccgaggtgccgggattgcagacggagtctcgttcactcagtgctcaatgttgcccaggctggagtgcagtggcgtgatctcggctcgctacaacctccacctcccagccacctgccttggcctcccaaagtgccgagattgcagcctctgcccggcagccaccccgtctgggaagtgaggagcgtctctgcctggccgcccatcgtctgggatgtgaggagcccctctgcctggctgcccagtctggaaagtgaggagcgtctctgcccgcccgccatcccatctaggaagtgaggagcgcctcttcccggccgccatcccaactaggaagtgtggagcgtctctgcccggccgcccactgtctgagatgtggggagcgcctctgccccgccaccccgtctgggatgtgaggagcgcctctgcccggccgcgaccccgtctgggaggtgaggagcgtctctgcccggccgccccgtctgagaagtgaggagaccctccgcccggcagctgccccgtctgagaagtgaggagcccctccgcccggcagccaccccgtctgggaagtgaggagcccctccgcccagcagccaccccgtctgggaagtgaggagcatctccacccggcagccgccccgtccgggagggaggtgggggggtcagcccccccgcccggccagccgccccatccgggagggaggtgaggggcgcctctgcccggccgcccctactgggaagtgaggagcccctctgcccggccaccacccagtctgggaggtgtacccaacagctcattgagaacgggccatgatgacaatggcggttttgtggaatagaaaagggggaaaggtggggaaaagattgagaaatcggatggttgctgtgtctgtgtagaaagaagtagacatgggagacttcattttgttctgtactaagaaaaattcttctgccttgggatcctgttgatctatgaccttacccccaaccctgtgctctctgaaacatgtgctgtgtccactcagggttaaatggaaaaaataaataaataaattaaaaaaaaaataaaaataaaaataaaaataaaaaattggtcagatcgcgagatcaggagttcgagaccagcctggccaatatggtgaaactctgtctctactaaaaaatacaaaaattggtcgggtgtggtggcatgagcctgtagtcccaactactcgggaggctgaggcagaaaaattgcttgaactttggaggcagaggttgtagtgagccgagatcgcaccattacactctagcctgagtgacagagcaagactccatctcaaaaaataaataaaatacaaaaaaaaaattggtttgtgtattttatatgcttacatatttttccatggtactgtaggtcattttagtgattaaatttgacacttttgacagaaaaacaggtcaattagttccttgggatcaaaaaggggttgattgcaaaggggcaggagggaattgatagagtgattttacaatggttctgcatcttgagtatggtatgactatgcatttgtcaaatcttagggtgaactttactgaatgtaaattcatgcttcaataaacaggactttaaaaacttacaaaaaaaaacacaaaacaacaacaaaaggactgggtgcagttcacacctgtaatctcagcaggggggccaaggtaggaggcttgagcccaggagttcaagcctagaatgagcaacacacagagaccccatctccacaaaaaataaaaaattaaccaggcacagtgtcacatgcctgtaatcccagctactcaggaggctgaggaaggaggactacttgagcctaggagttcgaaattacagtgagctatgatcacgccactgcactccagcctgagtgaccgagtgagagcctgtctctaaataaataaataaaactttctttaaaaaagagtccactatgtttaatgaggtggagatgccaaagtttccctagcaagatgtagaagaggcaattcaaaaacttagggagatagaaatgttggaatggatttttcatgtgtaacctatgttgcaaaaaaaagctcggaagataatcctttcactcaggcattgagaaatccattagtgaggtgggcatggtggttcacacctgtaatcccagtactttgggaggccgagccaggtggatcacttgaggccaggagttcaagaccagcctggccaacatggtgaaaccccgactgtactaaaaatacaaaaattagccaggtgtggtggtgcacaactgtaatcccagctacttgggaggctgaggcatgagaattgcttgaacccaggaggcagaggttgcagttagccaagatcgtgccactgtactccagcctgggtgacagagtgagactctgtctcaaaaaaacaaaaaaaaaaacaaacaacaacaaaaaaagaaatgcattagtgaggggatcaccttcatccttgaaaagctctgtggttgctcccctttgcagtgtgtccctgttcccctagacatgggttggcaaactttatttataaagggccacagataaacattttaggttttacagtccctaaggtctctgtcacaacccctaggtatggccatgggaaatgccaccactaagtgggttccctgatttaaaggggtaacgggatcctaaaataacagaggccaagtagcagcatgtaatcaccaaagacaaggtgggaaatctactataaatacagtaaagttgtactggtaatcagaacaccttggcccaccaggatctttggcagtaattgatcacacagtattccacaagcagcctaccaaaacagattcatctgtacaactgaaaaaaactccagctctggtagtaaaaacctgactagaaaagttttgacctctcatctaatttctagacccaagtcaattaacaagcccaggtcccctgaggaaaaacctgtagtgttcccacaagtacaagtacatactgtaaatcctcatccaagcttccccaaaggccatttactagagtgactacggattagagaaaaggaaatacccagacctttcagggattactaattcctggggactcaaaatgctactgtggcctatcagtcaaagtgagtgctgacagtggtcaggtaatagatgaaatgcttagctcaagtccacctcacagtggaccccatagtacaatgggcctactttgttgttatctcctcagttcctgaataaatacttggaacagacatacttgactattggcagagctcccatattggctttctgacccaactgataagagtcattttaatagtaagggctaaatggaagcccctagaacttaccctccctactaagatattaagccagaagcaataccacatctcaagaattaaagagcttaatgtcaccatcaaaagacttgaaagaaacagggtagtgatacctattatatcttgatttaactcgccagtttgtcctgtgcagaagtcagatggatcttagtgactatcataaactcgtggactatcataaacttaatctggtgatgattccaattgcagctgatgccccagatatagcatctttactggagcaaatcaacatgggtcacggcacttggtatactgctattaacctgaataatgcctttttcttcatacaaatctgcaagaaccaccagaagcacattgcttttacctgccttttacgtgcctatgaatctagcctcagggctatgccattctcctaccataatgtagcccacagagatcttgatcgcgtgacattccaaaaaaataaataaataagcacgtacacacacacacacacacacacacacacacacacacacacacacactagtcaactatactgacattatgctaattgggtctgataaatagcaagtagcaaatacgttagatgctttagtaagacatatacaaagtagttgatgcgagataaaccctacaaaaattcagagacccactgcagcaatgaaatgtcaggattcaattgctcaaaacatgtcaaaatttcccttccaaggtgattaagttgctctaattaacatcaccaacaatgaaaaagagggtacaatgtttggtaggcttcaacccagctacaaagttacctacaaggttgacagtttagagtgggtttcagagcaagaaaagattctatagcaagttcaagctgtggttcaagctgctctgccatttgggccttatgatctggcagatccaatgatacttgaagtgtccatggcaaatagggatgctgaatggagcctttagcaagcaagaataagagaatcactgcccagacttctagaattttgagaaaatctatgccctcttttgcagaaaattattcacctttcaaaaaatagtttcaggcttgctattgggtcttggcagagaccaaatgcctaaccatgggacataatgcaaccacgtgtcctgagcttctcatcaggaactagatgttatccaacctatgtagtctagcttggcatgtgcagcacgatctatcatcaagtgaaaaacacgtaaaaaaaaaaattcaagcaggtccagaaatatgagtaagttacataggaggtagctcagacttcagcattgagttctgttgcattgcttcctctccctcaatccaagtcaatggcctcctgagagctccatatgaccagctgactggggaaagaaaaaactcaagtctggtttacacatagctctgcacaacatgccagtatcacccaaaagtggggagctgcagcactacagccccatttaaagaggtaggactgaagggcagtgatgaagaaaaatctttccttcagagggcagaacgttgaggggtacatttggttttcccttttgcctgaggtaagacatggccagaagcagagatttatactcatttatgaacaattattaaggattttgttggctagttaggaacttggaaggaaatggtgacaaggaaatctgggggaaagatatgcagatgaaactctcagaacaggcacagactgtgaagatatttgtgtcccatgtgaataatcatttgcattcactgtagaggaggctcttaataagcaagttgacaaaatgacgtacttcatgaatataaatgttagacactttccatagctacaagagtgcttgctcaataaaacccatggaaaaaatcatcatgaaggctgtgcatggactcaacaacatgatcttcccctaaacagggctgacctgactaaagctactgctaaatgtctaatctgttaatggcacagactaactctgagccctgaatatgcaccatttcccaaaaactagctaaccacctggtggcaagttgattacgctggacttctattatggggaataagggcaggggtgagggaagagatttgtcctcactagaatagacatgtattctggatacagatttgccttctctgcctataatgtttttggcagttccaccacccatgaacttatatataagtgcccaatctaccaccatgacattccacacagtgttgcggctgcttctttttttgagatgaggtctccctctgtcgcccagtctggagtgcagtggcacgatcttgtctcactgaaacctctgccttctgggttcaagtgattctcccgcctcagcctcccaagtagctgggactacaggcatgtgccaccatgcccggctaattttttttgaatttttagtagagatggggtttcaccatgttagccaggctggtctcgaactcctaacctcaggcaatctgcccgcctcagcctcccaaagtgctgggattacaggtgtgagccaccatgcttggccaaaaaaaaagatgtatttttaaaatagagacaaggtctcactatgttacccaggctggtctcaaactccttggctcaagtgatcctcctgccttggcctcccaaaatgctggggttacaggcatatgccaccatgccaagcccacacagcattgctcctgaccaagaaagtcatttcatagtaaagaaatgcagaaatgggctcatgtccatggacttaactggtgttgtcacatcctatcacacagaatggttggcctaattaaaatagggaattgattactgaagactaagttacagtttcagggagacaacaccctgaaaggatggggtaatgatttcaatcagagacaccttacatggtgctgtctcctccctcaatcagaatatacaggtctgggaatcaaagggtagaagtatgtgcggctccactcactattatatctagcaatcactgaatttttgctttcactcctaacaactgagttctgctggcttggaagtgctagtccctaagcaggaaatatatctactagcatacacaacaatggttcaattgcattagaagatgagactgccacttggctacttgggactccttacaccactgaaccaacaggctgaacctactggttgggaaagattgagcccaattgtcaaggggaaacggttgctgctacacagtgaaagcaaggaggactatgtctgaaacccaagggattatctaaggcacctcttaatacttccatgccaaaaataaagattaatggaaaactacagcaaccaaaaaaggactggactaatgagggaataaatgtttgagtcatttcaccaggtaaagaacctcaaccagctgaggttcgtgctgaaggcaagggaaacatgaaataggtaactgaagaaagaagcctagatatcaactgtggcctcattactaatcacagaaatgaggatgaactttctctttgttatatttggtatttgtttgtatattctaaccattttcttctttccttcttcccattattataagttggaattagttcagtttagttttgtttttttgagaccgagtctcactctgttgcccaggctggagtgcagtggtgcgatcttgactcactgcaacctccgcctcccagcttcaagtgattctcttgcctcagcctcctgagtagctgggattccaggggtgtgcaccacacccggctaattttttttttttttttttttgagaccaagtctcactctgtcatcaggatggagtgcagcggcaagatctcggctcactgcaacctccgcctcccaggttcaagcaattctcctgcctcagcctcccaagtagctgggtctataggcgtgcaccaccacacctggctaatttttgtatttttagtagagacggggtttcaccatgttggccaggatggtcttgatctcttgacctcgtgatccacccaactcggcctcccaaagtgctgaaattacaggcatgagccaccgcacccgccttgaaattagatttataatacaacttttggtaacaaactagtcagtggaactttgttttctgccacatgaaaatctttaaagcttatgctgacgcatatctgaatgcttgtcatcaaagtgtgcagtaaaaaaaaaaaaggcagtttaagaaaatttgagcatttcaaagaaagcacttttaaaaatgtatatacatgaaggtggccgggtgtggtaactcacacacctgtaatcccagcacttttggaggccaagcgggtggatcacctgaggtcaggagttcgagactagcctggagaacccccgtctctactaaaaatataaaaatcagccgagcgtggtagcacacacctgtggtcccagctacttgggaggctgagaggcaggagaatcgcttgaatctgggaggcggtggttgcagtgagccaagattgtgccactgcactccagcctgggcaaaagagcgattttcaagggaaaaaaaaaaaaatgtggctgggcgcagtggctcacgtctgtaatcccagcactttgggaggccgaggtgggcagatcacaaggtcaggagatcgagaccatcctggctaacacggtgaaaccccgtctctactaaaaatacaaaaagaaattagccggacgtggtggcgggagcctgtagtcccagctactcaggaggctgaggcaggagcatggcgtgaacccgggaggtggagcatgcagtgagccaagatcgcgccgctgcactccaccctgggcgacagagcgagactccatctcaaaaaaaaaaaaaaaaatgtatatacatgaagaacattttgctatatcatgaaataaatgtagcgctgtaagataaaggaagatgaatataaatggagttttggccatttttatttttttttgagatgaagtcttgttctgttgcccaggctggagtgcagtggtgcaatcttggttcaatgaaacctctgcctcctgggttcaagcaattctcctgcctcagcctcccaagtaactgggattacaggcactcaccaccatgcccagctaactttttgtatttttagtagagacagggtttcatcatgttggccgggctggtcttgaacttgggatctcaagtgatccgcctgcctcgcctcccaaagtgctgggattacaggtgtgagccaccatgcccgggcagagttatgcccattttgcccctccacatgctgcagccatctttaacctgtttaacttaatgattatagttttgtttttcttttttcatcttattcagtatatttcaggctattcagcagatgcttgtgattctggaggttcaaatcactggtaaaagtttattctgtttcctcagtttttcaggagcttttctccattaaatgatctgctgcctaaagtaccctctgtcttcctcatcaacaggcgctaaattcaaaaagtaccttactgaaacttttttgttcataactttcattgttgg

SEQ ID NO: 1148 - DNA, 6401 bp, Homo sapiens
ccaggaaaaaattcacttaagaatgaatatggacacaaacaatttcatagactaccctggaagtggtctccaggatacttctcatcttgacattctatatttaaagctatttggtcactgaaagaaacaaggttgggcacagtagctgtcacctataatcccagcattttgggccaccaaggcaggagaatcgctggagaccaggagttctagactagcctgagcaacaaagtgagaccctgtaaaatatatatatattttacatacatatatatatatatgtatgtgtatatatatataatatatatatatatttttttttttaattagctaggcatggcagctcatgcctgtagtcccagatactcaagaggctgagatgggaggctctcttgagcctaggaggttgaggctacagtgagacaagatcacaccactgcacttcagcctggatggcagagcaagaccctgtcaaaaaagaaagaggctgcatgcggtggctcacacctgtaatcccagcactttgggaggctgagataggaggatcacttgaggccaggagtttgagaccagcctgggcaacacagcaagacctcatctctaaaaagaggaagaggggaagggaggcagggagggagggatattattttccatagccattaccatgatacatatgatactgcctaggtagagctgggactgtagggtggggaaccaatgctgtcctgcacactgagactatgaatgccaagatatcactgccagatccttctgtggatgaggctgggccaagcttgaagaagtcccctcagtggctggagatgcctacagcgttctataaaacaaagccactcctattaaaacttaaagggaagctatttgctttggttctctgagtatatctcttctttcagtccaatgagcagttagtgtctagctttgctctatgtgaaagccaatataatatggagatatttatggatgaaatggtatgctatctaggatttgcttctaaagaaaccaggggaagataagaacagtgaaatcaagattggtcatgagttgtcaacggctgaagttgagggatttgttttctctccaacttacttatttttacatttttgattgaaagacagaacagaaagtcaaagtgaaagatcaggaggtcaaggaatttttcacgtcctgtacaagtcctgggcacgaagctaaactaatcctactcgattcacgtcttgacgagcccacagatagcaaaatctgtggctcacagaatatggaattgacacagggttattttgagaaccatcttacagtccaaaagacatgactttcaaccaaggggaaaaaaaaaagaatttttgtctgtgtgtggaatgtctttcttcacatggacagctcagaggtgggcgaaaatgcagaattgggcagcaagaagtattgtccccaccttggaaggcctgcattcccctttctgtccagcaggccatcgagcccagcatggtttggcatgattcattgctctctaactttggacttaatgtaaaatgtttgttattcttgtaaagcaccctttagcagatagaaaatgattttccttcttgttgttagcttctgtttttgccctttttttcccccaacaaaagacagcagttttagaatgagactgagcctcatcactacaaaaggacttcagctccgattcctcatgccttgcttgggaaagcagcagcagacagagcaggagccatgctggcttctgtcaaacaaaggggttcaggggatcagccagagaaaactggagctaccactcaatctattcctgcctccaagtattcccgcaatgtaggaaagttgacagaaaaggttgagggtagggaactgaatctgagcctttgggcagtcctcttccacagtgactctggacttgacagtgtgacttgcttcagccaatggggataatagcaagcatgacgcaagcaagggttgaaaaatgtgtgtgccctggagcttgtacccttgcttttcttgggaaccctgtggtgtgaccactactatgtaaacaagccagagctagactgttgtgacaagagacacatggccaagccatcccatggccccagctgagactggaccaactaccagacatgtgagtgaggccaccctagatcatccattcccagccaagccactagctgaccacagtgattgaatgaaccagctgagaccagaactgccacgccagtgcacaaaatcataagaaagtataaacatttattatttaagttactgagtttgggtgattggtcacaccaaaagctaacacaagaaaaggtggctaagcagagctaagatgtattgaacattgggagacatatcccctaatggctctttacacaatagtcagtgggactcactattgatgcgactgtatgtcaactgtcattgaaataacctgacatagatccaaaattgaccatactccctaatactcatttcaagacaatgttagttgtaattcttggaatgctactgtatgggcttcaggggtttataaacctcctgaagttaaatgaagaattatatgtattttttcatctgaactgagaaaagatgttaaaactacagaggataacaaagaaatatatatgtacaactgcctagaattaataatatctcatcatatttgctttggatttttctatatgtaaagcaaataaaacattactgactcagtcgtctccctttcctctttcccccttcagtattttgaacttggtgtggatctttctagtctgtggatttttttaattaatttattaattaatttatttattttttgagatggagtctggctgtatcgcccaggctggagtacagtggaatgatctcagcttactgcaacctcctcctcctgggttcaaacgattctcctgcctcagcctcccgagtagctgggattacgggcgtctaccaccacgccaggctaatttttgtatttttaatagagatggggtttcgctatgttggctaggctggtctcgaactcctgacctcaggtgatccacccgcctcggccttccaaagtgctaggattacaagcatgagccaccacgcccagcctatattttttaaaataatatccacacaaatacatatatgtacacatacacaaataaatgtatagacccccaaatagcagtcttattttgtgtttttgacatttttcttacatggtttcagatatgcgtctttctacaacttgcttctttaccaaacactacccttgtgacacctatgcatattgataccatattatcaaacaagccacatgtatttctcttccaatgaacatttagattgttcctgttttgtttgttctcgtgatctgcggaatgtttatttgttattataaacactgtcagggaaaaggtcagtagcttccaacatattctcagaggactcaggacattctcccatccaaatgttaggaatctctgataatctgatgtggagaaagggcactgtcatcattttgcattgatgcatatttctgcattacagcattcccaagccttgaaggaagctatctttacttacattcttaaaatagcttattagattcttctgcatttaaatctaaaattttctataaggtctgcatcttcctaggacaccaaaaacagccctattattttttcattgaaaatttcttagaatcagataatactgtccaaaatattctgtgaccatgtaatgttatcctaaattgctgtcaacatcaaatggtggtcacaccgaagaaattattaggagactaacaatgtgatattctaattttgttgttgtattctgtaatgtatttaagaattaaacaactaaatctctgttgttctcacattttcctattttctattttttttaatcctagttaagattagagagccttctagtatgactttctttttttttttttttttgagacggagtctcgctgtgtcacccaggctggaatgcagtggcacgatctcggctcactgcaagctccgcctcccaggctcacgccattctcccacctcagcctcctgagtagctgggactactggtgcccaccaccatgcctggctaattttttttgcattgttagtagagacggggtttcaccatgttagccaggatggtctcgatctcctgacctcgtgatccacccgcctcggcctcccaaggtgctgggattacaggcgtgagccaccatgcccggccagtattactttcttttacttttatgcttgctctcactatgacatcttctagtctctatggcaaagtcccaaagcaaggaaattaaaactcagaacactactactcataacagacaatgttcttaagtctaaattatcccctctggtattactgaataaaatcaaccaaaattggtgattttctatcagccttaccttccctcaggagtatgtgaaataatgaaaaagtatacaaatacgtggactcggcattgtcaaatttagaaataatttattgaaccacttttcaaagagcatggacttagcagatctggctggtcacatacaaattgtgtggccctaagtaattcccctcccctcactacactttgattttcttacctgtaaaatggcaataaaaaccaacactggtgctagaatgaaatgaaatcatgtatatggaagccttttgttatcatttctccactatatggggagcttctcataagcagaggcagagagactaattcatctttttggagacggaatcttgctctgtcgcccagactggagtgcagtggcaagatcttggttcaccacaacctctgcctcccatttcaagcgattctcctgcctcagcctcccgagtagctgggattacaggtgcccgccaccccacccagctaatttttttgtatttttagtagagacgggggttttgacatgttggccaggctggtctcgaactcctgacctcaagtgatctgccctcctcggcctcccaaagtgctgggataacaggcctgagccaccatgcccagctctaattcaccaagcctgtatgctaacctcctttgccatggcaatgtcttctctccactttgaggttcaaagctctccatctccatccactcccgttctctggtaagaccactcatatttgccaaggaagacctagaggtctgagtacccactggtgtcacatatttgagtgtcaacgccagaatccagggggagcaccaatggtaggtacctttgggctagaacctgggaatgtggagtatgcatcccaagctcacccaaagagggggcttcttatctcaggagccaaagattaagcagcccattactgaccacagcggttctagtgggtggaaggaggaactctcccctgtacacacttctggaggaagtctccatacagttatgacacacagtgagtaatccggctacatgggattataatactgccaccaaaatataacaaatatgcttatcaagaaaaaggatttgtaaaacaagtggaaaaataacagaacacaaattgtatatttgccccataattacaaccacataaaaacaatgtgtttgaggcccggtgtggtggctcatgcctataatcccagcactttgggaggtcaaggtgggtcacttgaggccaggagttcaagaccagcctggccaacatggtgaaaccctgtccctactaaaaataaaacagttggccgggcatggtagtgtgtacctataatcccagctactcaggaggttgaggcaggagaatcgcttgaaactgggaggcagaaggaggttacagtgagccgagattatgccactgcactccagcctgggcgacagagtgagactccatctcaagaaaaacaaacaaacaaagaaacaatgcatttgaacagactgaaaggaaacccagagacaaaaataattactgtgttagggtgtgggggtactttgggtgaattattctaaatttctttttctttttttttttcttttttgagatgtgccccaggctgtagtgcaatggtgtgatctcggctcactgcaacctcggcctcccaggttcaagcagttctcctgcctcagcctcccaagtagctgagattacaggtgcctgccaccacactcggctaattttttatttttagtagagacagggtttcaccatgttggccaggctggtctcggacttctgacctcaggtgatccctccacctcagccttccaaagtgctgggattacgggcgttagccaccgcgcccggctgaattcttctaaatttcttataatgaagttagtacagtaaccttccacctacaagcagactttcttgaaaagtcccagaaagaaaactatctggtc

SEQ ID NO: 1149 - DNA, 3456 bp, Homo sapiens
atagtgtgcaaatgaagatggagttttcccttatatcccatttctccaatcttattgtgccagtctgccttccccgcttctgtccctcagcaatcaccaccagaaaattgtccttcactacatattccttgatggtattttagaaagagtagggtcattgcgctcaaacagaacttggttcaaatcccaactctccctgacttcagggaagagacgctgtggctcctggtggttaggagaactgggagttctccaggagagtcttcaggaaattgatggacaagggggatctcgctggcaggggaaagagaagtcagaggaagagaggttgggggcatagccctggtcccaaaccagttggcttttgcagagggtaagtgatacacaaaaaactatcttaagtagtttggacctgagatctgaagttgcccgtgtggttaaagtctcacctattttttagcaccatttgcgggagaggagtacctccttcttgaccctctgccttgctaccaaaccctctgccttcctgaataattgcttgatagccttctctttcttcctgccctctttgccaccccggaataccactacctgaaatgatctcatttctgcctatgtctacttgcttagtgctggtctcccctcactataatgtaaagttcataggacagaccttatctgccctgttcacaagttgttctcagggtctagaacagtgctggcaaatagtattaggtcaataattattaaaaaggtcaaatgaattggccgaaggcaattgcccccattcactctaacttagtaaattagttcctaattctggctgtgcactactgtcacctgaggctttattggaaacacagtttccagatcatcacccctggacagtctgattccatttgtttggggtgaacctgaggaatctgtatttttaattaacatctcaggcattttggacacagccagtgcctggactgataggtgggaattactcccacaggaaatgttactgaaaacagaactttattatcagcatcacctaaaccacatttcttatgttacagactataaattaaatatatatgcatgactttaaaaatatatacctccaagccacttccagtttgtgtatgtgcttctggcagaagcaattgtatttattcataccctgtatccaataaggtagggagacccagctgttcaagcaggtgcctccttcccaagaaaaagatagatcgattagattaacaattaagtggtgaactgttgagaggttgcccaaatggcctttgggctttcttctagaatggcatcaatgcacagtagaattgtggcagatggacgatagtgttgcatatgcactcatgctgggaatgaggccattttgagctcctccactggtccctcaaagggctgcctggtcggcttgatggcttgagttggcagtagggagtaacaactgagagcccgagctttagagacaaacagccctgggtctgaatcacagaatggccactgattaaagggcattttacatagcctttgcgagagcctcgtatgtttcatctgtaattaggaatgctgttctctaattcattggtttgtgctgagctattagtagagtgtggctggcattctgtatatacgatgctcaataaatgcaaatatcataacctctgggaagactgacttataccattccactgccgcaattgccgtaccaaatctccaaagactaagaaatctgcccctattggtcaatagaggggctaggcaaaagtgtttggttggtcatggaaaattgaggataatggaactttaatatgttaaaaaaattccttctccaaatttcatttgacacttgctatatgaatagttaggatttaatgaatacctttttatagagttacataattttcctgtaagatgcattgggtttccagaagaatgttgaacttgattcaattttagcttgattcgggctattcaaaatttatttcctgaggaatagtctcattggataaacttaggagttgttactggaagactgggtaactgtcataatgccaaacatcggtgctcctctccctcactgttacctaaattttaagaaatttctaggcaaaaaaaaaaaaaaaaaccacttgattaaggcagaggttattaagtatgggcaagagtgaagggcctggagttgatagtggaaaaaatatagcttagggaatttcatacccagaagcaaaaccaatatgtacatagatcttaatgctgtgtttcacttacagttcagagtccactgccttgcctagcatgttcaagatgttgtagtgccaccatcactgtatatgaaggctaattacttggaatattccttactgggtataagtgttccccaaagatttagcttaaggatggaactcaagagcccagcacaatcattccttttaactatttaaaatatattttggatgcacaacagactaattgattgaatgcacttttcacaattccacttatctaagatttttagaaaggcaccagaaatctcaagttgagattttagtattatcagaaatgtacaaaaatcatcagcctcctaaatcgacatcttgcttgagttcctctattcactctacctcctctgcacttatccagctcaatttctcatcccaagtgagcccatttaacatcttgtggctatcaacttacaaggtaagacagtaagagagggctggttctcaattatggccttatgttggaagcacctggggatctctacaaaactgggatcctgattgaattggtcagggtgtggcctggaactcaggctgttaagagcttcccaggtgattctcatccacagcccaggttctgaaccaatatttaaaatagcagagcatcccttaaaatagcagagcatccctttccccaggactagaggtgactcagctgtattttctgtgcctgtgtttgacgaattagttgcaaattatattcctgcttttacatagtaattaaaacagtcatgttttcatgggaggttccttcatgctgagcctatccactctgtcatttctttgcttccttagtatgttgtcttttaaatgagcttagtggaaaaagtctggttggtgcattctgagcctgctaatcatttctttcctttcccatccttttgagaatcgggccccagctcttaatctcttggtgtgcatgaatagttctcattagttgtggtaagtgcgttaagtgaaactaactatagaagctcactgaaactggaccgtgtaatcacattgttcatcagaagggattttaatgtttacatgcagaaaaaaaaattgtcatcacaagtagataaatagcccattattttacacttgagttggtacagcaggagcaaacagccaccaaactacttctgttgacattccagttgagctgcacataagagac

SEQ ID NO: 1150 - DNA, 6201 bp, Homo sapiens
caagcagtgacaaaataaacaccatctgttagtattgacttattccacagcattctcaggctgggtgattttatttcacttttttcagaaatggttaatgacacatctggtagtcagtgaaggtacactctgggtgattaaatgtggtcataagtttacactaaatgctgacagaacatttttttttcttttccattataagcaacggggcacatcggagtgcctggctggctactcattttaaaccttgtgtaggattaactgtttggcggtcgttgaacttccggaaaaacgttgttattttgagtcttctgagaagcagataccaagacaggattaggtatgcaagaaatttattgagggaaacacctgtgaaaactaaagcagaggtgcaggagaaggcgagaacagccttcagatggcaatgtgagtctggcaccagtgaagggagagtgggaaggaaagaggagtgggcaggaagagccccaggcagcagcacattctaaaacagtgtcagccaggacgctggggggtcctggagccccagttgcccatccgagcttttctgcatcctgcataaatgggcatgaattagtttcttcactgtgtccagtcattggcagagaacagacctaggaacctcagtacacacacagtagtggatctgaaggggatagccagtatggccctccatcaactctgttcccacagccagagatccgaggagtgcattttcatggtcaccaaaaatctcaacacaaaaaaatgaaatgatcaccgaattcatttatctctgcatgtctttttaaagaagaaaatacaatatttaaaatggccttttctcccctaatgtctccattggtctagcaggcatggcttgcactgcagaagactagcgtagctggaatagtaggtcccgtttatgctaaattctatcagtgaagggaaaggggagagtcctgaacactgttcttacctcttcatctgttcttttttttctttttttctttttttgagatggagtctcgctctgtctcccaggctggagtgcaatggagcaattttggctcctacaatctccacctcttgggttcaagcgattctcctgcctcagcctcctgagtagctgggattacaggcgtgagccaccatgcccaggctcttcatctcctcttaaactctcagagactctgctgctgctgttaattttgctttcagtgtgaagggttcttttggtttgccataattttgggcccatgacccgggaacttcacctcctatttgaaaagaaaatcatctgggaatggaagaggcgaaatttaggaaaaaaacacacttttttttttttttttttttttttttagtaattcaaaccccaaaacatattttgaggggcagaaggaaaaataattaatgctgtatatgatcacttcctacatgtcaagccattatattgttatcatccttaattcttaaactcttttgagacaagtaaagttatatttttatttacttttatgtatttttttttaagtttaacagaagaggaaagtgaggttcagaaagatctggtgactttttattggcacacaatgagaaagaacagattggggttttttccctgtttttcttgagttggtatacagagtagatttgccaaagagctcctcagttatgccagttactttacttatttgggaaggacttctcatatttatacagatatctttcttcacatcctgaaaagggcactgaacagagagagctgcatgctattaccattttttgcgactaaatacttgtgtggctgtgaattagttatccaggccttggttttttcatctgtaaagaaaggagattgggttagataacatttatcaaacttcagccattttccattttctatcaccttgatttctgtcccatctttaatgccacctataatatattgcttgatattttatttaaaataattcctccttgcaacttaagtgtctttaaaataaaaacattttgtcaccgcttaaaaggaaataccagtataaacaagtaaaattacacacacgcaatcacacacacatatatgtttgtatatatgtatgtacgtatatattcgtatatatgtatatatttgtatatatatccgtatatgcgagtatgtgtgtgtgtgtgtgtgtgtgtgtgtgtgtgtgtgtgtgtgtgtgtagagagagagaggaatataagcaatgaaatgctaggaacaaactgagactttctccttaatataaccagaaactttgaagacaaattgaaaacaaagtatttctaatgaaaatgttctggagacccaaagttgtttgacactttgtcacacttagtatcattttctgggcaaccaatgtcttatactgtgtcagacactggaaaaacatgacttatatattctgtctcacacacttgtgattttcctccctgccccaccccaaccttcatttacctttggcctcattttgcctcatccttccaattgcaaaatttgtaaggaccatctctcctctgactgcagaaatactctctgcatcttggctcatgagtagaaaaaaataagacctggaacaaataagaacaatttcttcctgttcttctgggaagtttcaagggaaggaagtagacagagctcgatagtctgggtaaagcctgaggcaagtcacactgtgtcttccaccagcaggtgtttacccagttaagatcagtttaaattgaatagtgtgcaaatgaagatggagttttcccttatatcccatttctccaatcttattgtgccagtctgccttccccgcttctgtccctcagcaatcaccaccagaaaattgtccttcactacatattccttgatggtattttagaaagagtagggtcattgcgctcaaacagaacttggttcaaatcccaactctccctgacttcagggaagagacgctgtggctcctggtggttaggagaactgggagttctccaggagagtcttcaggaaattgatggacaagggggatctcgctggcaggggaaagagaagtcagaggaagagaggttgggggcatagccctggtcccaaaccagttggcttttgcagagggtaagtgatacacaaaaaactatcttaagtagtttggacctgagatctgaagttgcccgtgtggttaaagtctcacctattttttagcaccatttgcgggagaggagtacctccttcttgaccctctgccttgctaccaaaccctctgccttcctgaataattgcttgatagccttctctttcttcctgccctctttgccaccccggaataccactacctgaaatgatctcatttctgcctatgtctacttgcttagtgctggtctcccctcactataatgtaaagttcataggacagaccttatctgccctgttcacaagttgttctcagggtctagaacagtgctggcaaatagtattaggtcaataattattaaaaaggtcaaatgaattggccgaaggcaattgcccccattcactctaacttagtaaattagttcctaattctggctgtgcactactgtcacctgaggctttattggaaacacagtttccagatcatcacccctggacagtctgattccatttgtttggggtgaacctgaggaatctgtatttttaattaacatctcaggcattttggacacagccagtgcctggactgataggtgggaattactcccacaggaaatgttactgaaaacagaactttattatcagcatcacctaaaccacatttcttatgttacagactataaattaaatatatatgcatgactttaaaaatatatacctccaagccacttccagtttgtgtatgtgcttctggcagaagcaattgtatttattcataccctgtatccaataaggtagggagacccagctgttcaagcaggtgcctccttcccaagaaaaagatagatcgattagattaacaattaagtggtgaactgttgagaggttgcccaaatggcctttgggctttcttctagaatggcatcaatgcacagtagaattgtggcagatggacgatagtgttgcatatgcactcatgctgggaatgaggccattttgagctcctccactggtccctcaaagggctgcctggtcggcttgatggcttgagttggcagtagggagtaacaactgagagcccgagctttagagacaaacagccctgggtctgaatcacagaatggccactgattaaagggcattttacatagcctttgcgagagcctcgtatgtttcatctgtaattaggaatgctgttctctaattcattggtttgtgctgagctattagtagagtgtggctggcattctgtatatacgatgctcaataaatgcaaatatcataacctctgggaagactgacttataccattccactgccgcaattgccgtaccaaatctccaaagactaagaaatctgcccctattggtcaatagaggggctaggcaaaagtgtttggttggtcatggaaaattgaggataatggaactttaatatgttaaaaaaattccttctccaaatttcatttgacacttgctatatgaatagttaggatttaatgaatacctttttatagagttacataattttcctgtaagatgcattgggtttccagaagaatgttgaacttgattcaattttagcttgattcgggctattcaaaatttatttcctgaggaatagtctcattggataaacttaggagttgttactggaagactgggtaactgtcataatgccaaacatcggtgctcctctccctcactgttacctaaattttaagaaatttctaggcaaaaaaaaaaaaaaaaaccacttgattaaggcagaggttattaagtatgggcaagagtgaagggcctggagttgatagtggaaaaaatatagcttagggaatttcatacccagaagcaaaaccaatatgtacatagatcttaatgctgtgtttcacttacagttcagagtccactgccttgcctagcatgttcaagatgttgtagtgccaccatcactgtatatgaaggctaattacttggaatattccttactgggtataagtgttccccaaagatttagcttaaggatggaactcaagagcccagcacaatcattccttttaactatttaaaatatattttggatgcacaacagactaattgattgaatgcacttttcacaattccacttatctaagatttttagaaaggcaccagaaatctcaagttgagattttagtattatcagaaatgtacaaaaatcatcagcctcctaaatcgacatcttgcttgagttcctctattcactctacctcctctgcacttatccagctcaatttctcatcccaagtgagcccatttaacatcttgtggctatcaacttacaaggtaagacagtaagagagggctggttctcaattatggccttatgttggaagcacctggggatctctacaaaactgggatcctgattgaattggtcagggtgtggcctggaactcaggctgttaagagcttcccaggtgattctcatccacagcccaggttctgaaccaatatttaaaatagcagagcatcccttaaaatagcagagcatccctttccccaggactagaggtgactcagctgtattttctgtgcctgtgtttgacgaattagttgcaaattatattcctgcttttacatagtaattaaaacagtcatgttttcatgggaggttccttcatgctgagcctatccactctgtcatttctttgcttccttagtatgttgtcttttaaatgagcttagtggaaaaagtctggttggtgcattctgagcctgctaatcatttctttcctttcccatccttttgagaatcgggccccagctcttaatctcttggtgtgcatgaatagttctcattagttgtggtaagtgcgttaagtgaaactaactatagaagctcactgaaactggaccgtgtaatcacattgttcatcagaagggattttaatgtttacatgcagaaaaaaaaattgtcatcacaagtagataaatagcccattattttacacttgagttggtacagcaggagcaaacagccaccaaactacttctgttgacattccagttgagctgcacataagagac

SEQ ID NO: 1151 - DNA, 5774 bp, Homo sapiens
gcctacacctgtatactctgctagaccctaattcaacatatccaaaacctctttattacttcccacaaaaatcagaatacataccttgcttcttattgccactatcattccttcaaacttttttttttttttttttttttgagacagagtcttgctctgtccctcaggctgtcacagtggtgtgatcatggctgactggagacttgaactcctgggatcaagtgattctcctgcctcagcctccgaaagtgctgggattataggtgtgagacattgtgccccagcccaggctaaaattttaataatagttttaaactctctctgctgtcaactttcatatacaatagattgccaaactccacagtctaacactatgacatctctcatacagtattttctttcctattgcctattttaggctgttgacactaaaaacaaaacaaaaacttgggaccccaatccaccatgtcaagagaaaaaattaagctgcaagctgagtcatgcaataaactgcttttccttttgttcccaagcagatagctacagataacaggttaaatatctccacaggtaattactctatgttcaccttatcttatgtaaagtcccaacttactaagcaaaagaaaatacgtaattgactattcccttgcctgctcctttcctctggcaacatgtggattaccataccttccctctttgctcttcagcctactttaaatattaaagccctcaaaatcatctttggagaaaggaacatacctgtctcccaggcatgtccttaaccttggcaaaagaaacttcaatcaatttagaagactcttggtttaaaatactcttagttgaactactgtgatcacttctctctgatttacttttctctaggttggaaccgattcaaatactaggtctccagattaatcttcctaaagtacaattctgttactaccactttactgctcaaaaaacaaaaacaaaactggggagcaaggaaagagtacatacctcgtttcttatgctgatatggaaagtcttccaggaaatgactctaacctatcttctcaggttaatttctatttcctttcctatatcctatactctagctaagtcacataactcactgactgggacataaaacatattttttacctttatacctgtgctcaaactgtatctaccacctaaatgcccttcccttttaaaaaattctatttatcttccaagattgatctttaaaaaggatcagtcctgctacctacagtgtagaaatgaatacagttttctagtcgagggactttaatttcatgttatgccttggttttcttgttagatatgctgtaggaaaagaacttcaggatttctataactatcacaatgaattctcaatgactcaattttctagttaactcctgacagaataggtgtgagattgctgactgtcatgggaatgctcacttaagtaatctagcccatgtgatagctctatttctcattataaagaaataagtactttctttagaggcagacaagtaagttaatgatgcagtcatgtcaatgaatgccaaatgatgtcacagctcaatatcagagccaaggtttcatagtaatataaatgcaaatgagataactgggtcactatattaaatggtagaaatactgggcttaaaataatctttgccatagtagtcagtaataattgcagagaattattgaacataaccatgtctggagctgtctgttcatcttacatgtattaactcatttagtcttcacaatagttctgtaagttaggaacccctattttataagtgataaaactgaagtgtagaaaggctatcaatttatctgtgagcaaacagaatgaaagcagcaaagccaaggattcaaactcaagcaggctggcccaaaagccttcactttaaaacactaatctatatgaatttacatggcaagcaaggattttatttcagcaacatattactgcctatcacatatatgttgtaaattaaatttttattggttttgccatttagtttgtatttaatgttacacatttaaaaagtgttaagagttgaggccaggcatggtggctcacacctgcaatcccaacagtttgggaggccaaggagggcgaatcatgaggtcaggagttcgagaccaccctgaccaacatggtgaaaccccgtctctactaaaaatacaaaaataagctgggcgtggtggcgcacacctgtagtcccagctactcgggaggctgaggcagaagaatcacttgaacacaggaggcagaggttgcagtgagccaagattgtgccactgtactccagcctgggcaacagagcaagactctgtctcaaaaaaaaaaaaaagttagagttgaataaaaacaaggtatttatatattaatattactattcatttgtatatacagaagtagcattaaaattaaaaaagcaatttagttaggtgccacttcattgacaaggcctttctagataacgtcactagatatgactgatttacttctttgaatactctgtaactctgaatactatgcaactatatactttgaatactgtgtaactctcttaaagtccaaattgaactctgcctgacaccactttgcattctattgtaacttcaacatgtatctcagctgatcattataactctacaatacctaagagaactttgtacacttgagcataataaatagcacatgctttcctgaagtttggctgcagagtgcaccctgaaaaagccataaatacacaaagcctgactgacataatctcagtactacataaagctgcaaggcctggattctaatagtagctttacctgccaatgattcagtgtgtaatcctgcccctccatctgagtctccttctgctaacagggaagaaagacattggtacatcaggcaaaagaagatgttataaagggcataggccagttaagccaattatgcctttcaaccctcctagttaaggctaaaggtattctaatttaagagacgttattctaatgactactttaaaaccccaaataagagaccttttagaaatgcaaagataattctttcttaaagaaccctttcgcatcctttacccaaggtaaaccagcccctaaaacatgtcatgattacgactttctcccttgacaatatcatttctactccaaaattgaatttgctctccaatactgacatcctctaagcatttttagattccagctgctcagtgactaaccaccaagttctgtagatttcacccttaagtatctgtggaatccactctttttattaccatccttactaacatagaccagtggttctcaaagtgtggtcccaccaccagcagccttagcatcacctgggaacctgttaaaaatgcaaacgtttaggcctcatcctagctgcactttaacactccttcaaagtgattctcaagtctgagttagttcttacctaatctgcctgaaacagtcttttaactggtctccactcccagactacttcccctatttaatatacccctttctacatatcccttgcatctacagatttcattagtacttttccattcactggagtagtaatttttcaaatattgtgaaatcaatccagtgggtcaagaccagttgtttggccgggcgcggtggctcacgcctgtaatcccagcactttgggaggcaaaggcaggcggatcacgaggtcaggagatcgagaccatcctagctaacatggtgaaaccctgtctctactaaaaatacaaaaaattagctggacgtggtggcaggcgcctgtagtcccagctactcgggaggctgaggcaggagaatggagtgaacccgggaggcagagcttgcagtgagctgagattgcgccgatgcattccagtctaggtgacagagggagactctgtctcgaacaaaacaaaacaaaacaaaaaagttgtttattttttaaaaagtgaaattagaagaaaacaaaatatcaaaattcatcacatatagaaaagtattgttgtgttaaacttttgcttcaaatacacacacacactcatttgacgaataggaaatgtatgtcattcctgttataggttataatttaaaaggtctgaaaaacacttgcctacagcagtggttctcaaactttactgtgcacaggctcaccacgggatctcataatgcagagtttgattctgtaggtctgggaagggccctgagattctgcatttctaacaagctcccaggtgatggccagactgctggtccttgaacctcacttttagtaccagaagctactcggctgagtaatcccagaattaacttgctacttcagcttccttaactcatgacataataaggtttattgaacctaagatatggcagatttgcaatgtgctagaaaatttcgctgactctgaagtttcagagaatgagcatggtgttgttctagttaactgatgaggaaacatacttttttttactttaactctggttgttagcatgttaaaatgtgtttcctatttcctgccttatgaaatcagctgagttaaaattagttttctttgattaagaattttgaattgcctcaggatattctaaaacaagatctctgacttgtaaatgtagagacatagagaaagaatgggctcaatttaatacgcaatagatgtgagaatatactctggatattgtaattttttactaagatcctgcaatgaaccacattttttggtctcttttttcatcaatttttgaagaaaccataaaaatagattatttagatccaatccaaaaaagtcagtgtgttataatgcaggggttaattcacggaactaacttattagatgcttactcagggccaggtacaggactagatgctggagataaagagatgataaggcaaagatccttccctggaggtattttatttaaagaatgctgctgtatatttcaacatctctgcagctgattggatgagggtttctgctgggtctttctcactgatttctaaggtaagcgcagagaccagtgtttcatttcctttgtaactttcccatagcacttggcacagtgctctgaaggccattaagtacaatagttgataaatgttgatgactaaccaactctttcattcaccaaattaaaaactgtactcacacagaatatgaaatgaagctggctaatggctcaatctgtgccattttgttatataaggggtttgttccatgttaaaatggaacattcaactgtgtagtatgaccagctacgtcacccttagcttaataaaaatgtcatgttcactgaggaatgactattcttcacctcccttcatttaggcagacacacaaggaatgagaaacttagttcacttttctaaaaataaaaattaaattattccaggttccataatggtttattctaataataaaccattctcgccagcatacacacacaaaatgaaccatgggtgaggaatttccagccttcgtaatagccatttttatttcatggttgtcagatgcaacatggccttaaaaatcatttactgtcattatttaagaaaatttttctttcttaagtttaaatcatctacagtgatcataaaaaatgaaatttcacttttgatgagaaagaggaaactatttttttttttttttgagatggagtcttgctccattgcccaggctggagtgcagtggcgcgatctcggctcactgcaagctctgcctcccgggttcacgccatgaaactacatgataaac

SEQ ID NO: 1152 - DNA, 8020 bp, Homo sapiens
tctgttaccgtattagcatttcttccatgagtgttaacctgcttccttaaagatagcatggtcttccaggttaccaccctaacctttatattcctaagccctggcattgccagctgcaactgtagaaatataactctatgaaactctccaccaatttattttgatgtcatataaatctatactagcccattctattgggcttttcatagtgaacaacttcctgtgattccacggatactcctatccattatatccaaattagtaaattagtcattttttaatcaaaacttagtaaaaaccatattcctgtgatgatataaatccttaaaaaaatttcagtgtaggtcactcctaccacttagaggtgagagatgtgaaggaatacttgtattaatactttttgcagttaggagtgacatcggccacaagtaataatctatctatcctatgctgtattcagtgacacagcacagcccacttagtgcaagattacatatcttttatacttgtcaatgtcatcgttaacagtagcagcaataagaacatctgatatatttcttttgataggttctgtactttacatacattatctcttttaattctcatgataaccctatgaggtagacattatttttatctcgtttccacagataaagaaacttgaagctcagtgagatttgtgctggagctagggctaggatttgtaaataatgaaagaaagatcaaagtgtccttgcatttcactgttccttctgcactgttattcttccatcttgactcaccaactatcctctgctcagctaatgctcaagtcactcccttactcaactctctcattttccttgtcgcaatcttccttctccaaggcactcataatcttccctctactctctctcttgccaatacagttggtgaatgaatctaccaacacttctgccctatagacagtctacctttgtaaaccaatagtttccaactccattccacttcagtcaccaattgacgtaaacttagacttcaatattagacatgcttcagctccaatatctcaaactcttaaaaacctgacaacaatttccactcttttcatactttctattcatctactgaatttcctccttgtaacctttttagactttacttgcatccttgcccatctaggagttcctgttgtaatttcaacaaagcacttggtaaatcattagaatcctttgtccccaagatcttctgccatctttccagtcctgggccatattctgcaatccttttcttgccatcattaagttgaatattctgggagaaaggtatattctcattctccaccatagacccatactagctgactccagctcatccttaaaaccgcttctactcatttgctgaactccttaataaacacgcagtgatagctgttccagacctttttccaccaccgtctccaaccccatttctacctctctccctagctgattcctttatcttttgtgagaacactgaggacttctgataaatgctttctacattttctttccttctccctcaaagtttctttatatcttctcactactcctttcccctagtctctgaattagatctatttccttttcaaggtgaaaccatccactgatgatcttgatcatacttcttctaacctccttacaaaactcacagacactctgtcttcttgattacttaactattatctttctctgctccttctctcaactaaaattatacacctctataaagaaaacaatacaactatttcttggaacgcattatcactctcctcccatcttctttcctctttctttgactgctaaatttgttctaagaactgtttgcatgcactacctctatttcttcagcattcattctctattcccctgtaatctcacaatgtatgaggtagaagggaagaacatgtttttctaaaggtcaccaataacttccaatcaccaaatcctatagccgtttttgtcttcagaccacctcctcccttttgtaattttctcctatcttggcatatgaacacttagcattctttgttcttaaattattcctttccggatttcctcttccctttctttctccttaaggtgagtcaaggtttttcagtatcaatcctctatcttctttctttctctcccactgtgagctttaacagtttcaaccataatctgtaagataactcccaaatttgtatccctacttgtacttctggatttgccagtttcttgctggatgcctacacctgtatactctgctagaccctaattcaacatatccaaaacctctttattacttcccacaaaaatcagaatacataccttgcttcttattgccactatcattccttcaaacttttttttttttttttttttttgagacagagtcttgctctgtccctcaggctgtcacagtggtgtgatcatggctgactggagacttgaactcctgggatcaagtgattctcctgcctcagcctccgaaagtgctgggattataggtgtgagacattgtgccccagcccaggctaaaattttaataatagttttaaactctctctgctgtcaactttcatatacaatagattgccaaactccacagtctaacactatgacatctctcatacagtattttctttcctattgcctattttaggctgttgacactaaaaacaaaacaaaaacttgggaccccaatccaccatgtcaagagaaaaaattaagctgcaagctgagtcatgcaataaactgcttttccttttgttcccaagcagatagctacagataacaggttaaatatctccacaggtaattactctatgttcaccttatcttatgtaaagtcccaacttactaagcaaaagaaaatacgtaattgactattcccttgcctgctcctttcctctggcaacatgtggattaccataccttccctctttgctcttcagcctactttaaatattaaagccctcaaaatcatctttggagaaaggaacatacctgtctcccaggcatgtccttaaccttggcaaaagaaacttcaatcaatttagaagactcttggtttaaaatactcttagttgaactactgtgatcacttctctctgatttacttttctctaggttggaaccgattcaaatactaggtctccagattaatcttcctaaagtacaattctgttactaccactttactgctcaaaaaacaaaaacaaaactggggagcaaggaaagagtacatacctcgtttcttatgctgatatggaaagtcttccaggaaatgactctaacctatcttctcaggttaatttctatttcctttcctatatcctatactctagctaagtcacataactcactgactgggacataaaacatattttttacctttatacctgtgctcaaactgtatctaccacctaaatgcccttcccttttaaaaaattctatttatcttccaagattgatctttaaaaaggatcagtcctgctacctacagtgtagaaatgaatacagttttctagtcgagggactttaatttcatgttatgccttggttttcttgttagatatgctgtaggaaaagaacttcaggatttctataactatcacaatgaattctcaatgactcaattttctagttaactcctgacagaataggtgtgagattgctgactgtcatgggaatgctcacttaagtaatctagcccatgtgatagctctatttctcattataaagaaataagtactttctttagaggcagacaagtaagttaatgatgcagtcatgtcaatgaatgccaaatgatgtcacagctcaatatcagagccaaggtttcatagtaatataaatgcaaatgagataactgggtcactatattaaatggtagaaatactgggcttaaaataatctttgccatagtagtcagtaataattgcagagaattattgaacataaccatgtctggagctgtctgttcatcttacatgtattaactcatttagtcttcacaatagttctgtaagttaggaacccctattttataagtgataaaactgaagtgtagaaaggctatcaatttatctgtgagcaaacagaatgaaagcagcaaagccaaggattcaaactcaagcaggctggcccaaaagccttcactttaaaacactaatctatatgaatttacatggcaagcaaggattttatttcagcaacatattactgcctatcacatatatgttgtaaattaaatttttattggttttgccatttagtttgtatttaatgttacacatttaaaaagtgttaagagttgaggccaggcatggtggctcacacctgcaatcccaacagtttgggaggccaaggagggcgaatcatgaggtcaggagttcgagaccaccctgaccaacatggtgaaaccccgtctctactaaaaatacaaaaataagctgggcgtggtggcgcacacctgtagtcccagctactcgggaggctgaggcagaagaatcacttgaacacaggaggcagaggttgcagtgagccaagattgtgccactgtactccagcctgggcaacagagcaagactctgtctcaaaaaaaaaaaaaagttagagttgaataaaaacaaggtatttatatattaatattactattcatttgtatatacagaagtagcattaaaattaaaaaagcaatttagttaggtgccacttcattgacaaggcctttctagataacgtcactagatatgactgatttacttctttgaatactctgtaactctgaatactatgcaactatatactttgaatactgtgtaactctcttaaagtccaaattgaactctgcctgacaccactttgcattctattgtaacttcaacatgtatctcagctgatcattataactctacaatacctaagagaactttgtacacttgagcataataaatagcacatgctttcctgaagtttggctgcagagtgcaccctgaaaaagccataaatacacaaagcctgactgacataatctcagtactacataaagctgcaaggcctggattctaatagtagctttacctgccaatgattcagtgtgtaatcctgcccctccatctgagtctccttctgctaacagggaagaaagacattggtacatcaggcaaaagaagatgttataaagggcataggccagttaagccaattatgcctttcaaccctcctagttaaggctaaaggtattctaatttaagagacgttattctaatgactactttaaaaccccaaataagagaccttttagaaatgcaaagataattctttcttaaagaaccctttcgcatcctttacccaaggtaaaccagcccctaaaacatgtcatgattacgactttctcccttgacaatatcatttctactccaaaattgaatttgctctccaatactgacatcctctaagcatttttagattccagctgctcagtgactaaccaccaagttctgtagatttcacccttaagtatctgtggaatccactctttttattaccatccttactaacatagaccagtggttctcaaagtgtggtcccaccaccagcagccttagcatcacctgggaacctgttaaaaatgcaaacgtttaggcctcatcctagctgcactttaacactccttcaaagtgattctcaagtctgagttagttcttacctaatctgcctgaaacagtcttttaactggtctccactcccagactacttcccctatttaatatacccctttctacatatcccttgcatctacagatttcattagtacttttccattcactggagtagtaatttttcaaatattgtgaaatcaatccagtgggtcaagaccagttgtttggccgggcgcggtggctcacgcctgtaatcccagcactttgggaggcaaaggcaggcggatcacgaggtcaggagatcgagaccatcctagctaacatggtgaaaccctgtctctactaaaaatacaaaaaattagctggacgtggtggcaggcgcctgtagtcccagctactcgggaggctgaggcaggagaatggagtgaacccgggaggcagagcttgcagtgagctgagattgcgccgatgcattccagtctaggtgacagagggagactctgtctcgaacaaaacaaaacaaaacaaaaaagttgtttattttttaaaaagtgaaattagaagaaaacaaaatatcaaaattcatcacatatagaaaagtattgttgtgttaaacttttgcttcaaatacacacacacactcatttgacgaataggaaatgtatgtcattcctgttataggttataatttaaaaggtctgaaaaacacttgcctacagcagtggttctcaaactttactgtgcacaggctcaccacgggatctcataatgcagagtttgattctgtaggtctgggaagggccctgagattctgcatttctaacaagctcccaggtgatggccagactgctggtccttgaacctcacttttagtaccagaagctactcggctgagtaatcccagaattaacttgctacttcagcttccttaactcatgacataataaggtttattgaacctaagatatggcagatttgcaatgtgctagaaaatttcgctgactctgaagtttcagagaatgagcatggtgttgttctagttaactgatgaggaaacatacttttttttactttaactctggttgttagcatgttaaaatgtgtttcctatttcctgccttatgaaatcagctgagttaaaattagttttctttgattaagaattttgaattgcctcaggatattctaaaacaagatctctgacttgtaaatgtagagacatagagaaagaatgggctcaatttaatacgcaatagatgtgagaatatactctggatattgtaattttttactaagatcctgcaatgaaccacattttttggtctcttttttcatcaatttttgaagaaaccataaaaatagattatttagatccaatccaaaaaagtcagtgtgttataatgcaggggttaattcacggaactaacttattagatgcttactcagggccaggtacaggactagatgctggagataaagagatgataaggcaaagatccttccctggaggtattttatttaaagaatgctgctgtatatttcaacatctctgcagctgattggatgagggtttctgctgggtctttctcactgatttctaaggtaagcgcagagaccagtgtttcatttcctttgtaactttcccatagcacttggcacagtgctctgaaggccattaagtacaatagttgataaatgttgatgactaaccaactctttcattcaccaaattaaaaactgtactcacacagaatatgaaatgaagctggctaatggctcaatctgtgccattttgttatataaggggtttgttccatgttaaaatggaacattcaactgtgtagtatgaccagctacgtcacccttagcttaataaaaatgtcatgttcactgaggaatgactattcttcacctcccttcatttaggcagacacacaaggaatgagaaacttagttcacttttctaaaaataaaaattaaattattccaggttccataatggtttattctaataataaaccattctcgccagcatacacacacaaaatgaaccatgggtgaggaatttccagccttcgtaatagccatttttatttcatggttgtcagatgcaacatggccttaaaaatcatttactgtcattatttaagaaaatttttctttcttaagtttaaatcatctacagtgatcataaaaaatgaaatttcacttttgatgagaaagaggaaactatttttttttttttttgagatggagtcttgctccattgcccaggctggagtgcagtggcgcgatctcggctcactgcaagctctgcctcccgggttcacgccatgaaactacatgataaac

SEQ ID NO: 1153 - DNA, 28097 bp, Homo sapiens
agtattattactttgttgttatttggctctggtcagatttcaattaacgtcacaataggatttaaacatttcttttattatttttaagattttaggccaggcgcactggttcccagcacgttgggaggccgacgggggtggatcaccagaggtcaggggttggagaccagcgtggccaacacagtgaaaccccttttttactaaaaatacaaaaaaattagctgggcgtggtggcatatgcctgtaaccccagctattcgggaggctgaggccaggagtttgagactagcctggggaaatagtgagaccttgtctctaccaaaacaaaacaaaacaaccaacaacattaggccaggcgtggtggctcacacctgtaatcccagtactttggggggctgaggcgggtggtggattgcctgaggtcaggggtttgagaccagcctgggcaacatagtgaaactctgtctctactaaaatacaaaaattagctgggcatggtggtgggcacctgtaatcccagctacttgggaggctgaggcaggagaatcgcttgaacctgggaggcggaggttgcagtgatccatgatccggccattgcgctccagcctgggtgacgaaagtgaaattccatctcaaaaaaaaaaaaagttagctggatgctggatgtggtggcatgtgcctatagtcagccactcagaaggctgaggtgggaggatcacttgagcctaggagttcaaggctgcagggagccgtgatcataccactgcactccagcctgggcaacacagcagactctgtctcaattaaaaaaaaaaaaagcgcagaagaatattggtttatggagagtattattttaagttttagaaattttctatgcaaaacaaacaatggaaaataagaaatgcattactctataataaaatatagccttttctctcccatatatatatatgagtggataaaaacagtcataacttcctacacatttaatcctctatactaactctcatacccacttaccactccctcaatgacaaacataccaaaaagatgctaaataaatgaaaacaatactttgtattcttaactatgtaaagtattgtacttaacaggtattttcttggctgactggttctccatacccaacaaacacagtgatgtcaactctcaccactcatattaaacaatatagccattgctgtaaagtacaaaagagaaatgcagtacaaattgaaaaggaggaaataaaacttttattcatcgctgatattatcagatacataaaatcccaaggagacaaaagctactactaatgagattagaaggatcccagaaacagacacagacgtgcacacacacctccccacagacacagatacacactcacaacacactcagaagtacattttattttattttgagacagtctcgctgtgtcacccaggctggagtgcagtggctccatctcagctcactgcaacctccgcctcctgggttcaagcgattctcctgcctcagcctccccagtaggtgggattacagatgtgcaccaccatgcccggctaattttttgtatttttagtagagatggagtttcaccatgttggccaggctggttttgaactcctgacctcaagtgatccactcgctttggcttcacaaagtgctaggattacaggtgtgagccaccacacccagccagaagtatcttttaaacaggatttttaaaagtgggagttgaccctttccaaaatctggagttgggatgggcattagtggtttggagaggaaagagcaggtgtgttgtggctgggaggcgattcctttcagcaccttgggtgatgtctgaggccatacccactttctgtgctatttttgggattatgatgattaacccacactccctttgttcctcccatgtaacctggattcttgggcattcaaccaatattaaacccttcctctgaaaaattcctggattgacaagagcacactggacccatttccattccccatcgtgatcaataggtatcaaaagaaatgatagcttcttagaatagaaatttgcagccactggggaatgtagttcttaaatgtgaatacagaagaatctcttattacaaaattctgtatggctctggatttaagattttgttattttttatttttgagacatggtctctctctgtcactcaggctggagtgtggtggcatgatctcggctcactgcagcctctgcctcccaggctgaagcaatcctcccacctcatcctcccacctcatcctcctgaggagctgggaccataggtgcgcacgaccacacccagctatctttttgtatttttatattttgccaagttgcccaggctagtctcgaacttctgagctcaagcaatctacccaccttggcctctcaaagtgtcgggattacaggtgtgagccactgcagacagccaggatttaagattttaagagatattgaaagccttttgttataataccattgaaaacataaaatacttaaaattaacaaaagttgtgcaatagcataactacaaatcattgatgagagaaattaagtatctaaatgaagagatttatcatggccacgaattagaagacttaatattgttaagatgtcagttcttctgaaattgatcaacagattacttgtaatcccaataaaaatttcagcaggctgtttttgttttggtataaattagtaacatgattttaaaattctaagctgtggctgggcaaggtatctcacgcctgtaatcccagcactttgggaggctgaggcgggcagttcaccttaggtcaggagcttgagaccagcctggccaacatggcaaaaccctgtttctactaaaagtacaaaaattagctgggcatggtgttgggcacttgtaatcccagctacttgggaggctgaggcaggagaatcacttgaacccgggaggcagaggttacagtgagccgagttcgtgccactgcactccagcctgggcgacagagcgagactctgtctcaaaaaaaaaaaaaaaaaaaaaattctaggacgtatatcttttacaactactagtcaaagtaattataaaagagtaacaggccgggcgcggtggctcacgcctgtaatcccagcactttgggaggccgaggcgggcggatcacgaggtcaggagatcaagaccatcctggctaacatggtgaaaccccgtctctactaaaaatacaaaaaattagctgggtgtggtggcgggcgcctgtagtcccagctactccggaggctgaggcaggagaatggcgtgaacccgggagacggagcttgcagtgagcggagattgtgccactgcactccagcctgggcgacagagcaagactccatctcaaaaaaaaaaaaaaaaaaaaaaaagagtaacgaattcagagggctcaccttattttacaataaagtagtgtaggcatatactgatcaatgaaacagaaaagaaggtctagaaacagacacttatataatcaactgatttttgattaaggtgccaaagctattcaatgggagaaaggaaagtcttttaacgaaagtgttggaataactgaatttccttaaggaaaaaatatgcttttgctcttatttcacgctatatttaaaaattaactcataatgactcagacttaaaagtaaaagctataactatgaattcttcaaaagaaagcataggagaaaatctttgtgaacttggggtagacaaagatttttaaaatggaaaaatcgatcatagttctttatttggaaattaaaataaaaatgccataagcaatgacacaaaaaatggcatacctagcattacatttggcttacatttagtgtaagatctacacagtaaaacccgctaaacattgctgtgtcatgttgaggaattttttccttccttcccttccttccttcctccctccctctttcttttcttttctcttttctctttctttctttcctttctttctttcttttcttccttcctttctttctttttctttctttcctttctttctttccttcctttctccatctcttcctcctttcctccctccctcccttttattttccttccttccttccttccttctccctctctttttttttttttttaagacagagtctccctctgtcatttaggctggagtgcagtggcacgatcacagctcactgcagccttgtcctcccaggctcaagccatcctcccaccttagccttccaagtagctgggactacaggtgcacatcaccatgcccagccaatttttgtattttttgtaaagacagggtttcaccattttgccaaggctggtcttgaactcctgagctcaagcggtcctgcctgccttggcctcccaaagtgctgggattacaggtgtgagccaccgcacctggccaatcttttctttttctttcatgaaagttgtactatttatggagtacatgtgatgttttgacacatagacaaaatgtgtaataatcgaatcaaagaaattcggatatccataacttcaggcatttatcatttctctgtattaggcacattccaattccactctcagttattttgaaatatactataaatcattgttaactacattcaccctattgtgctaccaaacactagatcttattctttccatataactgtatttttgtacccattaaccatctcctttttatcctcccttctccactaccctttttagcttctgctaaccatcattatacctctacctccatgagttcaattttttttagctgtcccatagtagtgagaacatgtggcctttgtcttcctgtgcctggcttgtttcacttaatgtaatgtcctccagttgcaactgtgttgtaaatgcaggatctcattcatttttatgactgaatagtactcctttttgtgaattttctttatccattctatccacattttctttatccattcatctgttgatggacagtcaggttatttccaaatcttggctactgtgaatagtgctgcagtaaacataggagtgtggatatatcttggatatactgatgtcttttctttggatatatacggtgggattgctggatcatagggtcattttatttttagtgttttggggaacctccaaactgttttccatagtggttgtactgatttagatttccaccaagagatatgtatgagagttcccttttctccacattcttgccagcatttgttattgcctgtcttttggataaaagccatttgaactagggtgagatgacatcttattgtagttttgatttgcatttctctgatgataattatgttgagcactgatatggtttggatctgtgtccccaccaaatctcatgttgaattgtagctcccaatgttggaggtggggtctgctggagggtggttggatttctcatgaatagtttcatactgtcctcttggtgctgttcttgtgatagtgagttctcatgagatttggttattcaaaagcgtacagcacctccccgctcactctctcttgctcctgcttccgccgtctaagatgccttactccctctttgctttctgccatgattggcagtttcttgaggcctctccagaagcagaagctgctgtgcttcctgtacagcctacaaaactgtaagccaattaaaactcttttctttataaattacccagtctcaggtatttctttatagcagcgtgagaatggattaatacaagtctcaggtatttcttttcttttttttgagatggagtctcactgtgtcgcccaggctggagtgcagtggtgtgatcttggctcactacaacctctgcctcccaggttcaagcaattctcatgcctcagcctcccaggtagctgggactacaggtgcccagcaccacgcctgactaactttttttgtatttttagtagagacagggtttcaccatgttggccaggctggtttggaactcctgacctcaggcgatctgcccgctttggcctcccacagtgctggggttacaggcatgagccaccgtgccatcaggtatttctttatagcagtgtgagaacggattaatactagcaccttttcatatacctgtttgccatttgtatgtcttcttttgagaaatgtctattcaaatcttttattaattttaaattggattattagatttttttcctattgagttgtttgagctccttatatttttttgtgaattattctttgtcagatggaaaacttgcagatatttattttcttccactctgtaggttgtctcttcactttgttgattgtttcctttgctgtgtagaagcgttttaacttgatgtgatcccatttgtccatttttgctttggttccctgtgcttgttgggtattactcgagaaatctttacccagtgcaatgtcctggagagctttctcagtgttttctttagtagtttcatgtttgaggtcatagatttaagtctatgatccattttgatttgatttttgcatatgtcaaaaaataggggtctagtttcattcttctgcatatagatgtccagttttcttggcattgtttattgaagtgactgttatttccccagtgtatgaatgttcttggcacctttgttgaaattgaattcactgtagatgtatgaagttgtttttgggctctttattatgttccatcggtctacgtaacttgttatgctagtaccttgttgttttggttactatagctctataatacgatttgaagtcagataatgggattcctccaattttgttctttttgcttaggatagctttggctactctagatcttttgtggttctgtttaaattttagaattgttttttctgtttctgtgaagaatgtcattggtattttgataggaattgcattgaatctgtagattgctttgagtagtatgaacattttaacaatattgcttcttctaatctcactgtgtcgcccaggctggagtgcagtggctccatctcagctcgctgcaacctctgccttatgggttcaggcaattctcccacctcagcctcccaagtggctgcaactgcaggcgcatgccaccgtgcccggctaatttttgtatttttagtagagatggggtttcaccatgttggccaggctggtctcgaattcctgacctcaagtgatctgcccacctcggcctcccatagtgctataattaacagtatgagccatcaagccctgccgtatttcattgtatgaacatattacagttcatttatccattcacttgttgaagaacatcttggttgcttacaagatttggcaattatgaataaagctgctataaacatctgtgcagaggtttttgtgttgctatatgttttcaactcatttgggttaataccgaagaacatgattgctgtagcacatggtaagaatatgtttagctttgcaagaaaccgccaaattgtctttcaaagtagctgtgtcattttgcattcccaccatcaatgaatgacagttcctgttgagccacctccttgtcagcatttgatgttgtcagctttggattttagccattctaataggtgagtagtggtacatcattattgtttcaatttgaaatggctactgacatatgatatggagcatctttccttatgcttatttgctatgtgtatattttctttggtgaggtgtctgctcagatcgtttgcccattctttaattgggttgttttctattgagttttaacagttctttgtgtattttgaatgtaagtcccttatcaggtatgtcccctgcaaatatgttctcctagtctgtagcttgtattgtcattctcttgacaattcttttgcagagcagaagcttctaattttaatgacacagaacttatcaattgcttctttcaaggattgtgcttttggtgttgtatctaataagccatcaccaaacttaaggtcatctagattttctcctacattatcttctagaagttttgtactcactattcatttaggtctacaataaacttggagttaattttcgtgaaagccgtaagggagcttctaagggggacacacactaacttctttgagagtgggcagtgattgtgaaactctcagctgggtcttacaacagaccccagatccatcaggagagcccagccttcagaacccatagtggaatatgtttcatgcatacacggaggagaatatgcagtcatatgctcacatgcatgtctgaacatgatcacacacatgaatatggctatgtcctgatccagagttctctcattctctgtaagtgattctttccttcaacttcttcattaagggatatattgacagaatgtcattaaaattaaaaacttctgctctgcaaaaaattgttaatggactgactctgtatgtccattcatgtctcgttgtgtccctggactgactctgaatgggctacagtggccttatctggtagcaagcacagattacacccgggtattcaaagcatgttgagtaggtgagagtgtgggcatgtgtgcagtgaaggcaggacagccacccgccaggtctctggaaaactccccaggacagggatgttcaggccatgtgatgctatactaagctgttttacgtgaggaataggtgctttttaagaatctgtctagaaggctatgggcacagatctgtgttcaaagattttctgggcacttatgttttgtgagacatcagagacaactttctaagcctcagttttgtcacgtgtaaaatgggcatgaacgcccttcgcagaggtttgtggcaattaggtgagcgtgcaatggtttttgaacaaaggtgacacgggggtacgtgctcaggaaataagagctgctattattactactcttcatagcataatgtaagggtttccttcctctcatcccagctcggaagcaccttatcaaggtgaactgagccgcttctgtttcttctcttccctctagccaccacgccccttcctttccgccatcctgcccccagtcttagctgcgcccctctcccaagcccggtcttggccctgccctttccctggccccgcccaccagacctgcaccggcacagccctcgctcagcggggcaggaagctcatggtgtagtttcgtgggatcgtggcaaagcccacgtgtttgggggacacgtcaatgtccttaggtgactgggaggacttgaggcggaagttctgcatgacggtggtgaagaagagaaagagctccattctggccaggccttctccgaaacagttccgctttcctgaggaggagaggcgggaggggtggaggtgaagcccactctcagtgcagcctcgccccagtaccgacctccagctgcggctctcccagggaggaagggtggaatattatggcctgagagagtttcagaggaggctctgatcctccctgagcctcaatttctttctataagagatgtaacaatggtgaaccaatattgatatattattactaacaaagtccatagtttacattagggtttactctgtgttatacagttctatgggttttgaaaaaggcataatgtcacacatccatcatagatggggtgatccatgccaggtgtagcaatgggaggtttagatgtcctttcctgccaggtacacttgcaaatatgactgctgtgccgtcatctcctttttagggatctgaggaatctgctgtgtgaccctagagaaatacatctacggggaaagatgtttcctttcattttacctgggcgcaggtactgggtgcttggtagttaaggaagtatcagctgctggctcaagggtagattctaacaggaacttccaagctggagaaataccaggctacaccgcagagaggggaggagggtgagggaggcccctgctggtgtgagccgtggcctggcagcaaacagtggtctcttaccgatggaaaagggcacaaaagcatcactcttcttaaactgccccttctcattcaggaagtgctggggattgaagtcctgggggttggagaagaaactggggtctctcagcacagagcccagcatagggaacacttcggtgccctggtagggaggaggaagttgtgtgtgatgaggagggtcgggggattggtgaaagtacacaggggctggagggggaactagtgtgccccaggtaaggggaagtggcaggcatggaggagttggggtcctctgatggaggagctttgggggatagaaggttcacatctctgaaacaggaagtttgggagacatggggtccatgtccttctaggcaggagtttgggggacctgagatttctgtccctatgacaaaaggccgaatggaaagggggcttctgtttcttaagataggaagtttgggaacatgtgtttgattctcctgacacaaagagtctggagagatgcaggactcaggagtgtctaagtggaaaggtggaacggatgtggtggttggggaagtcttttttgactgattgagggagtgggacagggtctagaaagcttctaatgtgggtgggatgctggggacacagagaggggctggaagtccccgtagtctggggggtgggggcggatagcaccttagggaggaagaaatcccgaaacttggtgtcctttttgactctgcgggccaaactcatggggatcacgtctccaaatctttggatctcgtggatcactgcctccatgtagggcatcttggcccggtcctcaaacttgggctgccggttcttgccgatcactctgtcaatctcctcatggaccttggctgggggaggagggggaatgtgtttaggtatctaggggtctcagagcaggaaatgatagtccgaataggcaaaatggggtggatgatatggctccgcctatgagacggaagtagagcattcataacagaacagacatcagccattcgcattgttggagtaggatcctgttaaccaggttgtgccagaatcacaggggaggcacagggaggaacttaggggatgacccggtggaacgggcagtgggcactcagtgggcttgggacagaagtgactgaccaatcagtgcagacattttcaatattttaatatctaatgagactcagctgatgcctaccagctgaatgttgccctgtctctggacagcaagtcacgtctcagggtcccgggatctgggacaggtggggacattgcaccagtcgaaggggaattttgagggtctggggccctccacttccgtccccctccagccttaccctccacctctgggtgcttcatgagcagcaagaagccatagcgcagggtggtgctgacggtctcggtgcccccaatgaagaggttcaacgtggtcatcaccaggtttttcaagtagaactccgtgttggggttcttctcctcctgcagggagagggggctttaggccaacctcactcctcttgccctcagggcccttctagggcttttcctttggatctacctctctttggttcagaccaaaggtggaaagagggaccctagatctaccagactcgctctaggttccagcccttgccctggctgctggctttgcccaaaatgctcttccttctcaccttctttaccttgctgaccatctgtccttcaattatcaacttagctgtcagtttttttttgtttttttttttcttatactgacttggtcttgctaagttgcacaggccggactccaactcctgagctcaagcaatcctccagcctcagcctcctgagtagctggaactgcacatgcgcatgaccatgcaggctcacttactttttaaacaattaattaattttttttgacacagggcctcattctgtcacccagactggagtgcaatgccgtgatcttggctcattgcaacctctgccccccttcgcgccaccatgcccaactaatttttggatttttagtagagacggggtttgaccatgttggccaggctggtctcgaactcctgacctcaggtgatccacctgcctcggcctcccaaagtgctgggattacaggctgttagccacggcacccagccaattgtgaggattattatgatgagggttaatttgaatgggcctgtgtcatctgcctgccccactcccagactgatttccctctgcctggctttgcatctccccgcagtggctgctggggtgtacctcctgcatgcggatgagaaaggagtcaatgaagtcccgtggggaattgggatccagcgtgcgctggttgtgctccaccttcttggctatgaagtcctccagcccttgcagcaactgaaaggcctgttgctgtggtcctggcaggtgtttcatcaccgaagagaacatctcatagagctggggttgcagagagaggatgggaagggaaggacagctgtcacggggcaggagctgatgggaatgggatttgtttcatagcaaggaaggaactgagttaaaggcatctgtctcgttgtttaggtatttcagtggggccggataggaacttatatctaagttttcaggaaggttaggtaccagggccacggtctagtaatttaggtgagaagaactgagacatatatccaggtttcaggtatttaaacgaggctggattggagcacacatctaggtgttcagatattcaagtgaagttgagttggaagacacctgtccaggtgtttagctcttcaggtggggctggtatgaggtgagtgtcacctgtctaggtatttaggcattcaagtaggcttggttggagacagctgtccagatacttactgggtctggattgggggcttttgttcaggtgctcaggtattaaagtggggctggtgaagatgttgaagtggaggggatacctgttgaggtgtttacctatccaagtgggatgcactgggagcacctctgtaaggtgtgtgattggaaagggttggggaacacttatttgtgtgtcagggaacaatctgtctagatatttatgtgtttaaggtgttggttagggcagctgtccatgttttcaggtatttaagtgggtgaagtagagggcgcttggccagatattccagtgggctaatctgggacatttgtgtagatgtgaaatgattatgatgggctggattttgcagcaccaggtgttcaggtatgcaggaggccggttgacgcagtcacttgtccaggtgttaaaatattcagaagaactgggtagggagcatctgttagaaattacggtaagttggggatgggaacacgtgcccaggtgagagagctgagctgagggtatgcatcctgccagcaggctctgttttggggagcatctgttgagctatccaggtgtccttggagacagggtattggacatccatcctgggttctggtgcaactgtccagttgtccaatatcggggactgattttgaggggacactgtctggagggcggtgggagtttggggcacctgtctccaggtaggggagcagttggcaggttgtggtaggggcgtcacgggccgggctgcagccagttacctgccccgtggaggttgacgtgaactggaagattcctagcatcatgcgcaacagtgacaggaactctttgtccttatagtcaaagcggtccccaaagacaatggagctgatgacattggagactgtgcggctcaggaagaaggtgggatcgatattggcgcctgcgggtatggcgggagaagggggttggggagagagtcaactcagaggtctgaggagagtcagaattccaggaggcagggccttgttgagccaaattcccagcgccagactccagggctggaagtgcgggcgcctttccccacctagtccccatccccaggcagaacgcgcgcgggttcctcgtcctgggtgttttccttctcctgcccccgcactcggggtcccctgctcaccgccagtgccccggagggcgtcgatgaggaagcccgcctcctcctggatgcgctcctcgatgcctcgcttgcccaccccgaagtcccgcagggtggcgatggagaagcgccggagctgcttggcgcgctccccgttgctgaataccacgcctggggaggtgaacgcgggaatggagacaggccagggggcggcaggggcaggagcggagcagctccaaggggctccccaagggtggaggagagagggagtagggtgggagagagatggattcagcgccattgcccagcagagctgcaaactcagtcagagaaacacgatgtcgaggtagagagagagagagagagagagagagagagagagagaagagagagaggagagagagagagagagagagagaagagagagaggagagagagagagaagagagagaggagagagagagagagagagagagagagagagagagagagagagaccaggtttaaagaataagacaatcagaaaagaaacagaaaggccagacagagagatgcacatagaaacagagggataaggggacactccatggaggaagggaaggaagtggggagagaaagagagtgatggaggaagaggatggagggaggggaagtgagatatggggagatctgggaggaggaaataaaaatggtgaaagattcttaagctgagctggagaagagagaaaaatattgagatagaaacagagagggtctggaaggaagagagactgttaccaggagatggaggctgaagatgtggaagtaggaataccctgaaatcctaagacagaggaagaagtgagaaagggatgcggagagatgagaaacacagagaagcccagaagctaagagggacaaaaagacaaatgaagacagagaaccagggctggaaaacagaaacccaggatgtccttagagatggagagagaggggaaagaggagactccagtgagagagaataaggaggtggggcagagagaggcagggaggaatcaggacagggacgctggagacaggtgagggatacacatggagaggccacaatgaagggagatggggagggaagaccagactggggactctgccttagcctccagttggcaggagagtcagggagaaggctgggaacactgagaccttcgtgtccacctggccaccttccccctcttgggcaccccctcaccatagcctttgaagacccagtcgaaggtggcttgctcgcctcgcccgctgaactcctcagcctggtccaccagagcctccctgacggcatcatgtccacacagcaccacgacccgccggggccccaagtgaatggtgaacacggggccatagcgctcactgatctgatggaggtgggtgggagtggttagagggagaagcctccactctgaatggggcccagcaccgagatgtcatgtgctgggatgcttcgcacccaggttctcacagtcagggagctggacatcccaagatcctgtctttctgatgctgaaactccaaaactccatttcctaagactctggtccacactggtcaaccccctgccacaaagccccagccaactaggcagcccccaccccgtgccacccatctccctgccttgggacaccttcatgagggagttgtacatctgctctgtgttcagctgcaggtagtttccaatgaagggcaatggggtgggtcccggaggcagcttccccttgctcttcctctgctgccaaacagacatcaagaccattacagtcaggcagaccagcaaggccaccagaagcatccctgaggccagcatggtggtagtgggatgatagatggtgacggctggggtggtttgcctttatactgcctgaaaaagagggatggactttggctgattacataattacctcatttcacctcccaactacatgccccaccatgaatcctgcctagcttgggacacagccagcaagggaggataaggggaccccagggcagctgaacagagagggggcctccagactaaatctgtggtacttcaggaggggtgccgcagggctgtggatttaggagggggcaacagataagctgtagaactgaggagtttggaatatttgcataggggagcacttgggctttggatttggggtctgagagtgagaatgcaccccaaagttgtggatctgggggttccaggggagaggaatccaaaggtctgggttttattagggtaagacaaagtgtggctgtgcatttaggggtcttctgttgtggaggatgcagggttaagggtctcaggaagggggattccaggcatatggacttgaaagtctcggggctaggaagacccagggctgtgggtgtggagtttctgggaggaggagtgtgtagcaagcccagcgggttctcccagaaagcccagcagcccagcactgggtccaggggctgacttgattttgcttttgcccagagctgtctcttgatgcccagaatcctcattggaacctcagagtgaggccaggatgggtgccatagaacctccactgcccatctctgattgggaaggggaggaagaccagagccatatttcaggggaactttccccacacctggagaagagtacctggagttagcggttggcagagggattggctaggtctggagaaatagtaataacaacccccaaatggtggaaaaatctcaagtgtcccaagggttgtccgctggtttccaacccagatcctcagggaaacccactagattgattgtatcatccctattaatattatgattgttgtttatgtttctcattttatataaagatctacagaggacagaaaacagacagtgggcaggggacatgtgtgagtggccctgaactcccatctctcctgctctgtgtacttagttcccctttctggatttggttttcctgccagtggaaagggagtgtttgggaagagaagatcacattcgagggtgagttaagtctcctttaagaatgattcctgctttgtcaggggctactactattagcaggcagagggaacagtggcagaagagattggggtaaactccagtattaggcacagaggcagatcctggggtgggtgtgagtggagaagggatgagtagccctcctgtccttccctcagggaaattcttccttagtaaacaggacagttaccctttggtgagcatggtcgtatacgggaagattaagtctaggtgtgtatgatctggttgaatctttgtaacaatgaggttggttcatcatgatcatcctcattttgaagatgagcagatctagactccataaatcctcttgagtgaggtcacacagggagtaagtgagggagctgggatgtgaactttctcctcaccccccttcattgactggcctagatcaccctgggagtcaagtgcaggccagccttagcaggaggtgagtgctgggactggcatcagcagtggacacactgatgacattggtgggttctgatatcagcatcaggtatggccagggagggaaaggcatcgtgttggctttgggactgcccccaggtgtatgcgaggatgggaaacaagttggcactgaacttgacaccaggagaatattgaagtcatgtttggtgccaagagggctctgtgtgttgtctcaggtgtcattgagggcataagagtgtcctgcttcaggagggcgtaagggtggcaccatatagggtctgaggttggtcccagtgggctgtgacatgagcatgaggcaggtgctgatattggtcctatgtgggtctgagatgagcctcagccagaccctgagaggggccccagatggccacaggacaggctgtggtggttggaccatttagggttgcacctgtcctctgggtcaccaactttggacaagtggaggtgggtgaggttggcacccccaggactgacatcttgctcaaactgttctaggatgctgagctctgagacctgtgtggagggaacaaaggtcagagaacaaggcagagagaggaaagttgtttgttgattttggaggggaagaggtgggaaggaagattagcaccagcttggcagatatcaatcgctctaatcctgttcaccagtctgcacctgggcctggctcctccttttccttcgtgtttcttaaaaaggtgggagacagaaatctggggagtttgtttctcactggggttggcactaggaagtgcactgagtgatcagcaggttgccatgacctggccagggaggggatggggagagacaggttgggagaactctagtatttgtggacatagaggtcaatgaattttggacttgttgattaccctagagcatggagtgagagaatggtgtctgaaatcatgtgggagggacttgtcccagtgggcagtgtcttgggaacaggctttcagagtgagttagtggcgagcccaggaagatccctttcctttgctgggcctcagtttccctttctgaatggatggtgcaatgattaaggcctggattggaatcctaaccttatcctttctttgttgtgtggctttgaacagctgacttcatctctctgagtcttatggagccaagaacagctcctacctctttggctatttaggggagaagtataagtgttaatgcagatgaggtacatggcagtaagtgctcaatgaatggtagttgttctctttaatctgtaggatgaagcggatggatgagatgttccctaagcacattccttgcttttacattctctagtctaaagctcacaaatcttttcctttgggaaggaggaaagggacagagtctttgggaacctccttcgccatcccttcctcagcacagccaagctttaccccatggagctgtgaataggaaattaatccttcatggcctcctggagtgtggtgctgagttaggcagtatctgcggaaggacaggccagcattagactctcaggttattctggttggccctggagccctgcacaggactttgcccacctgtctgtctatgcttgtcttggatcccatctttctatctttctctttctccttccctgcaagtcagtgttcccctcaatcaccctgtgtgctcatgcatctttgtgttttgtgccattttgtccagtgggttctcctggatgcctctgccatgtttatcctcatttatacaactgtgtgtgtgtcattctgggtgcatgcttttagtgtctacgtgtatgtatgtttcagcatgttcatgttgatacatgaatttatgtgtgcaccaggctttgtggtgtgtatgtttgtgcttgataatgggtatccattccaacttatgtctgcacatgcacatgtgtgtgtgtgcctgacagggtgtggcactgtttctcaatgcttgccaatctttgtgtctgtctctgcatacagcatgtgtgcacacatgatttaggggtgtctacgatgtgtatttctgtgtagaacaagatgaatgctgcatattcatatttgtgtgtatacattcacaattgggtgactacatataagtatgtggatgtttttttctttgtttttttttttgagacagagtcttgctctgtccccacgctggggggcagtggcatggtctcggctggaacctctgcctcccaggtttacaccattcatctgcctcagcctgctgagtggctggggctacaggtgcctgccaccatgcccggctaattttttgtatttttagtagagatggggtttcaccatgttagccaggatggtctcgatctcctgacctcatgatccgcccgcctcggactcccaaagtgctgggattacaggtgtgagccaccgtgcccggccagtacgtggatgttttcatgtgttcattctggtgtgtgtgtgcagacttgtgggccatgttgcatacacgtgaacatgtgatattttcctgtgctcatctgtgtttggattaaaacagtcctatcccagctccatttatctgcttgaaaaaacccccagaactgcaggaagctttttatgagcataatcttaattgaactcctgattgcaagactgaggttagctttatcatctccattttgcaaatgagttagataagttcccccaaagccggtcataagtgacttgcttctgcatttcacagctaatgagtgtagagtcttagtatggtcttgtgtgatggtaaattttttttttttgagatggagtttcgctcttttgctcttgttgcccaggctcgagtgcaatggtgcgatcttggctcactgcaacctctgcctcctgggttcaagtgattctccagcctcagcctcccgagtagctgggattatagccaccagacacagctcatttttctatttttagtagacacggggttcaccatatttgtcaggctggtttcaaactcctgacctcaggtgatctgcccacttcggcctcccaaagtgctgggattacaggcatgagctaccacgcctggctgtgaatgtaagtttcatgctgttaatcaccactttggactgctaggccccacctgtttttctttatgaaacattagaaaaactgcttgtactcccttgtatttcttcaaatacttccgtgtaaacatgtaacaaaagatttcaaaatgttagaaaaaaaaagtcttttaataggagggagacttgaccttctatagtgtttgcactctttggaaccttaagcaaagacctagttggccagtatagccctcatgccattggcaatgaagcagtgggggagttggggtattagtggttgtggtcagagagtgaaatgtctgtgtttcacatttcagattgatgacaaggatttggggggtggggctgtgggaatgttggctgaaaatagagtgaagaaggtcaaagaagagaagacagtcaagattctttttttctgagtgtttggatagctcacatccatggccatgaagttcctccctaccaggaaaatggcaggacttagagttcagagatgggacatttagtaaatagtgctacaataaacatgaaagtgcctcaacatactaattttttttttgaggcagagtctcactctgttgcccaggctggagtgcagtggtgcgatctcagctcactgcaacctctgcctctcgggttcaagcaattctcctgcctcagcctcccaagtagctgggactatagacgtgcaccaccatgctgggctaatgtttgtatttttagtagagacagggtttcattatgttggccaggctggtcttgaactcctgaccttaagtgatccgcccatttggcctcgcaaagtgctgggattacaggtgtgaaccactgtgcccggccagctacacactaccagatctcacgagaactcactatcatgagaatggcaagggggacatctgccccctgattcaatcgtctctcaccaggcctctcttccaatattcgggattacaattcaacatgagattggggtagggacacagacccaaactatatcaccttctctgtggtaggttatattgttttatatttttatttttttgagacaaggtcttgcttcatcgccaggctgcagtgcagtggcatgatcatgggtcactgtagccttgacttcctgaggctcaaatgatcctcttatcctcttatctcagtctcccaagaagcatgccaccatgcatagcacattaaaaaatttttcttgtagagagaggtctccttatgttgcccaggctgatcttgaactcctgggatcaagtgattctcctgcctcatcctcccaaagtgctaagattttagacatgagccaccccacccagtgattatattgttttatttatttatttatttattgagacagaatcttgctctgttgcccagactggagtgcagtggtgtgatctcggctcacagcgacctccacctcccaggttcaagtgatacgcctgccttctgctgctgaatagctgggactacaggcgcccaccatcacgcccatctaacttttgtatttttagtagagatggggtttttcgccttgttggccaggctgctctcaaactcctgacctcaagtgttctccccaccttggcctctcaaagtgctgggattacaggggtgagccaccacgcccagcttatattgtgttgaaaatgttttcttctctcccactggtcctttccttaggtaagaattacactttcctctaccccatggacaggcttggctgtctacttgctttggccatgactcctatcaactctttttctttttttttttttttagacagagtttcgctgttgtcgcccagcctggagtgcaatggtgcaatctcggctcgctgcaacctccacctcctggattcaagccattcttctgcctgagcctcccaagtaactgggattacaggcacacgccacaacgcctggctaattttctttgtatttttagatggggtttcactgtgttggtcaggctggtctcgaactcctgacctcaggtgatctgcccgcctcggcctcccaaagtgctgggatgacaggcgtgagccaccgtgcccggccaactctgttttgttttttttttttttttgagaaggagtctcgttctgtcgcccatgctggagtgcagtggcgagatctcagttcactgcaacctccgcctccagggttcaattgattctcatgcctcagcctcctgagtagctgggattacaggcacatgccaccatgcctggctaattttgtatgtatatgtgtgtgtatatatatatatatacacatatacctgtatattcagtagacacggggttttactatattggccaggctagtcttgaactcctgacctcaactgatatgccggcctcggcctcccaaaatgctgggattacagacatgagccactgcttccagcctaactctgttttataccaaaggtctcactgggctccagtaactacttcctccatttccactctcagggatggggtggcaatggagccccactgttatgggcttccaggatttcccttaatgctgccctcaactttgtaaatagtcctatcattaaactctcaattatcctgtttgtgtatgacttatcattcctgctgggatcctaacccacacagcacttcattgtatggatgaaccatttatttagccagttctttaatgatgaacatttaggtcatttccaatctttcactattaaataaaactgcagtaaataaacttgtatataggtgatttttcacatagtcaaatacaactacaggataaattattatatatggagttgctgaatcaaataatgctgtttaaaaataattttgactgatattgtcaaatcatgtatagaggtgtacagccctattagcagaggataaggatggggacttttcctttggagcaagcccagaatcctgaatgttccaacagctgaagatgaggactgctaagagaactcaaggtaaagaacattagatttctggcaaataggtgtaggtgggtatcttgagtaattcattgaataaatgaagtgtgtaactgtgtttgttccccatcttggaatttttaaaaattattgcttttagatggagtctcactctgtcacccaggctgtagtgcagtggtgagatctcgcctcactgcaacctccacctcccaagttcatgcaattcttgagcctcagcttctccagtaggtgggactacagacacacaccaccacacctggttaatttcttttgtatttttagtagaaacggggttttaccattttggcgaggctggtcccgaactcctgacctcaagtgatctaccagccttggtctccccaggtgctgggattatagatgtgagccaccgtacccagaggatattgttgattataattgttacagaagttttcgaaggtttgtattagaaaatgttaagtctcagaggactgtcttagttcattttgtgttgctataacataataccagagactaggtaatttacacagaaaagagacttatttggcttatgattctggtgactggaaagtccagagcataatgccagtgtctgcttggcttctgtgatggctttcatgctgtatcataacatggcatgaggtcgaaggggaagtagacatttgtgaagggtcaacacatgagcggtgtcctcaatttataacagtctgcccttgaaggaatgaatccattcccatgagaacgaatcctgttttgcaaaatgagacctcactcactaccttgagaaaggcaacaagccacccacgagggtggagctcatgtgacctatgtgcctcccatcaggcctcacctcttaaaggtttcacctcccagcattaccgaaccgggaattcaggggttccagcatgaattttgacaggaacactcaaactatagcagaaactatgaccctacagatagtgattgtaatatttcaagtctttggtatagagactgtaatttccaagatttcatgaatctttctttcatacatggaaggctgggtaagtcaaagattttcaaagattttcagcctcctcccaagagacagtacccatgcatggttagggtctgaatgagcaattgttattcaattgtttgttatgaaatatgacatgtggcttttgggtttcttgctactctcttatgcctcccctcagtcagtgggaagcagcccaaactggaattgaagctgtcaacacaaacctgaaaatgttcagaacttgataactatagtataattataaatcgcacagggccctggtagttaaatcacttcacacttgactttatttgcctgtctgtagaataaagagcaggaaagagtcaaacaagatatggtttgagtcagagcactgatactttttgtagctgtgtaactgtggggaggtcagtcaatgcctctcagaatgaatttcctcacctgcaaaataataataataatgacaataataataatgatagaaatgtactactttgatgcactgatgtattacagaaagaaaaaaaggcaaattttgtctttaaactctcagtttaaatcagtaaactagataccttttttttttttttttgagacaacatgtccctctattgcccaggccagagtgcaatggcatgatcataactcaatgcagccttgatctcctgggctcaggggattctcctgtgtcagcctccccagtagctgggattacaggtgcacatcatcatgaccagttaatttttaaattttctgtagaggcgagatctcactatgttgctcaggttggtcttgaactgctggcctcaagcaatcctactaccttggcctcccaaagtgcttggattacagctgcaagtcaccgtgcctggctgaactagagtgcttctatctaatcctataggaatcccttatttcttattgctgcaggatgaaaattaaacacagattttaattgtgtggattgaagaattatatcagaagttgaaatcacatcctcaccaagtcttatatgtgaaagttagggcattggttgggaaggagaggaaccctgatacttcgaatggggatatctgggtagcctcagatgaaactgagtcactctgagcatcctttctgaatgaatgtatcttcccctctcatggtcgaggacactagttttctctttcttataataacaggggagttatcttgaaatgggcagtatattctcctcaatactcaccttgtttatttatttatttatttatttttgaggtggagtctctgtcacctaggctggagtgcagtggtgcaatttcagctcactgcaacctccctcccaggttcaagcgattctcctgcttcagcctccgagtagctgggattacaggtacctgacaccatgcccagataatttttgtatttttagtagagacagggtttcaccatgttggccaagcttgtctcgaactcctgacctcaagtgatctgcctatttcagcctcccaaagtgctgggattacagatgtgagccaacatgcccaacctcaccccatttattattttctgtctacagatccctaattagagtcagatcgcagcatattttgggtgacaagtacaagtatgatcttggagataatagcatatactccaaaataattgcaatgcttcttgtattttgcataggctgaaaccaaagttaatagaaatggtaatataggctgagcacagtggctcatgcctgtaatcctagcgctttgggagaccaaggcgggaggttcacctgaggtcaggagtttgagaccagcctggctaatatggtgaaacctcgtctctactaaaaatacaaaaattagctggacgtagtggcacgtgcctgtaatctcagctaccagggaggctgaggcaggagaattgctggaacctgggcggtggaggctgcagtgagccgaaatcccaccactgcattccaacctgggcaacagactaagactccatctcaaaaacaaaaacaaacaaacaaaaaaagaaatgataatatattataagggtgttagatcaaggagaatagaatataatattagattgggctgaatttgtagatcgtggtatacttaaccagaaattctggattgagtatgttagctcaggcagctttaaatggctctaagaattgagataggtgttgagagaaacttggtctcaagagtgactttaaagtcaatgaacttgagatgccacaacttcatcagcattgttcagaggaaggaatccagaagtttggagagataggaatgttggagtgggtttattgtgtgcaaccctctctgtattgcctcacccactagatcttctatgagtgctcatcatctctcttcatgaaggtcatgaagagaggtctacattaagaacttttgggcttggccaatggaaggttgagagaagagcaaggtcagattatcgtgcctggccatgtgataacagtggttgtattcctctgccagaaaccatgtcctcctgctggaggctctcttttacccctatacagtcagtctcagtttcagaaacttgtccctctcactgcacctttccacctagggatgatgatggcttatccttactgtaagccatagagtgcttcaacatcttgtaggtttccttcacactgccctcaactttgtaaaaagtccctccattggccaggcacagtggttcacacctgtaatcccagcactttgggaggccgaggcgggtggatcatgaggtcaggagatcgaggccattcttgctaacacggtgaaaccctgtctgtactaaaaatacaaaaaactagcctggtgtggtggtgggcacctgtagctccagctacttggtaggctgaggcaggagaatggcatgaacccgggaggcagagcttgcagggagccgagatcgcaccactaaactccagcctgggtgacagagcaagactccatcacaaaaaaaaaaaaaagaaagaaaaaaaaagaaaaaaaaacccctctattaagcactcatattttcctgctgggattctgatgcacaaagtctatcaaatgaatgcatcataatttgtttaaccaatatcttggtgcacattttggtttcccgttttccattatgtaaacagttctttgatgaatctagatgattttgcacactgtcatgtacatcgtaggagacattactagaagtggagttaactgagtccaagagtatgttcttttgtaatttagacaaaagcgttcacattactctcctctgaagctgtaccaatttacagttccaagaaccgtaactgagagtaaggattgctctgggaggctgaggcaggagtggataccagcctgggccacatagcgagacaccacctctacaaaaatatttaaaattttttctactactagggtgtagtaccctagtactgcctgtggtcccagctgcttaggaggctgaggtgggaggattgcctgagccagggggtcaaggctacagtgaattatgattgcaccactgcattccagcctgggtgacagagcaagacattgtctcaaaaaaaacaaaaaaacccaccccaaacaaccaacaaaacaagaggccatgttttcacacccagtgatcttaatagctcaagttttgctttagagactgtggttt

SEQ ID NO: 1154 - DNA, 30931 bp, Homo sapiens
agtattattactttgttgttatttggctctggtcagatttcaattaacgtcacaataggatttaaacatttcttttattatttttaagattttaggccaggcgcactggttcccagcacgttgggaggccgacgggggtggatcaccagaggtcaggggttggagaccagcgtggccaacacagtgaaaccccttttttactaaaaatacaaaaaaattagctgggcgtggtggcatatgcctgtaaccccagctattcgggaggctgaggccaggagtttgagactagcctggggaaatagtgagaccttgtctctaccaaaacaaaacaaaacaaccaacaacattaggccaggcgtggtggctcacacctgtaatcccagtactttggggggctgaggcgggtggtggattgcctgaggtcaggggtttgagaccagcctgggcaacatagtgaaactctgtctctactaaaatacaaaaattagctgggcatggtggtgggcacctgtaatcccagctacttgggaggctgaggcaggagaatcgcttgaacctgggaggcggaggttgcagtgatccatgatccggccattgcgctccagcctgggtgacgaaagtgaaattccatctcaaaaaaaaaaaaagttagctggatgctggatgtggtggcatgtgcctatagtcagccactcagaaggctgaggtgggaggatcacttgagcctaggagttcaaggctgcagggagccgtgatcataccactgcactccagcctgggcaacacagcagactctgtctcaattaaaaaaaaaaaaagcgcagaagaatattggtttatggagagtattattttaagttttagaaattttctatgcaaaacaaacaatggaaaataagaaatgcattactctataataaaatatagccttttctctcccatatatatatatgagtggataaaaacagtcataacttcctacacatttaatcctctatactaactctcatacccacttaccactccctcaatgacaaacataccaaaaagatgctaaataaatgaaaacaatactttgtattcttaactatgtaaagtattgtacttaacaggtattttcttggctgactggttctccatacccaacaaacacagtgatgtcaactctcaccactcatattaaacaatatagccattgctgtaaagtacaaaagagaaatgcagtacaaattgaaaaggaggaaataaaacttttattcatcgctgatattatcagatacataaaatcccaaggagacaaaagctactactaatgagattagaaggatcccagaaacagacacagacgtgcacacacacctccccacagacacagatacacactcacaacacactcagaagtacattttattttattttgagacagtctcgctgtgtcacccaggctggagtgcagtggctccatctcagctcactgcaacctccgcctcctgggttcaagcgattctcctgcctcagcctccccagtaggtgggattacagatgtgcaccaccatgcccggctaattttttgtatttttagtagagatggagtttcaccatgttggccaggctggttttgaactcctgacctcaagtgatccactcgctttggcttcacaaagtgctaggattacaggtgtgagccaccacacccagccagaagtatcttttaaacaggatttttaaaagtgggagttgaccctttccaaaatctggagttgggatgggcattagtggtttggagaggaaagagcaggtgtgttgtggctgggaggcgattcctttcagcaccttgggtgatgtctgaggccatacccactttctgtgctatttttgggattatgatgattaacccacactccctttgttcctcccatgtaacctggattcttgggcattcaaccaatattaaacccttcctctgaaaaattcctggattgacaagagcacactggacccatttccattccccatcgtgatcaataggtatcaaaagaaatgatagcttcttagaatagaaatttgcagccactggggaatgtagttcttaaatgtgaatacagaagaatctcttattacaaaattctgtatggctctggatttaagattttgttattttttatttttgagacatggtctctctctgtcactcaggctggagtgtggtggcatgatctcggctcactgcagcctctgcctcccaggctgaagcaatcctcccacctcatcctcccacctcatcctcctgaggagctgggaccataggtgcgcacgaccacacccagctatctttttgtatttttatattttgccaagttgcccaggctagtctcgaacttctgagctcaagcaatctacccaccttggcctctcaaagtgtcgggattacaggtgtgagccactgcagacagccaggatttaagattttaagagatattgaaagccttttgttataataccattgaaaacataaaatacttaaaattaacaaaagttgtgcaatagcataactacaaatcattgatgagagaaattaagtatctaaatgaagagatttatcatggccacgaattagaagacttaatattgttaagatgtcagttcttctgaaattgatcaacagattacttgtaatcccaataaaaatttcagcaggctgtttttgttttggtataaattagtaacatgattttaaaattctaagctgtggctgggcaaggtatctcacgcctgtaatcccagcactttgggaggctgaggcgggcagttcaccttaggtcaggagcttgagaccagcctggccaacatggcaaaaccctgtttctactaaaagtacaaaaattagctgggcatggtgttgggcacttgtaatcccagctacttgggaggctgaggcaggagaatcacttgaacccgggaggcagaggttacagtgagccgagttcgtgccactgcactccagcctgggcgacagagcgagactctgtctcaaaaaaaaaaaaaaaaaaaaaattctaggacgtatatcttttacaactactagtcaaagtaattataaaagagtaacaggccgggcgcggtggctcacgcctgtaatcccagcactttgggaggccgaggcgggcggatcacgaggtcaggagatcaagaccatcctggctaacatggtgaaaccccgtctctactaaaaatacaaaaaattagctgggtgtggtggcgggcgcctgtagtcccagctactccggaggctgaggcaggagaatggcgtgaacccgggagacggagcttgcagtgagcggagattgtgccactgcactccagcctgggcgacagagcaagactccatctcaaaaaaaaaaaaaaaaaaaaaaaagagtaacgaattcagagggctcaccttattttacaataaagtagtgtaggcatatactgatcaatgaaacagaaaagaaggtctagaaacagacacttatataatcaactgatttttgattaaggtgccaaagctattcaatgggagaaaggaaagtcttttaacgaaagtgttggaataactgaatttccttaaggaaaaaatatgcttttgctcttatttcacgctatatttaaaaattaactcataatgactcagacttaaaagtaaaagctataactatgaattcttcaaaagaaagcataggagaaaatctttgtgaacttggggtagacaaagatttttaaaatggaaaaatcgatcatagttctttatttggaaattaaaataaaaatgccataagcaatgacacaaaaaatggcatacctagcattacatttggcttacatttagtgtaagatctacacagtaaaacccgctaaacattgctgtgtcatgttgaggaattttttccttccttcccttccttccttcctccctccctctttcttttcttttctcttttctctttctttctttcctttctttctttcttttcttccttcctttctttctttttctttctttcctttctttctttccttcctttctccatctcttcctcctttcctccctccctcccttttattttccttccttccttccttccttctccctctctttttttttttttttaagacagagtctccctctgtcatttaggctggagtgcagtggcacgatcacagctcactgcagccttgtcctcccaggctcaagccatcctcccaccttagccttccaagtagctgggactacaggtgcacatcaccatgcccagccaatttttgtattttttgtaaagacagggtttcaccattttgccaaggctggtcttgaactcctgagctcaagcggtcctgcctgccttggcctcccaaagtgctgggattacaggtgtgagccaccgcacctggccaatcttttctttttctttcatgaaagttgtactatttatggagtacatgtgatgttttgacacatagacaaaatgtgtaataatcgaatcaaagaaattcggatatccataacttcaggcatttatcatttctctgtattaggcacattccaattccactctcagttattttgaaatatactataaatcattgttaactacattcaccctattgtgctaccaaacactagatcttattctttccatataactgtatttttgtacccattaaccatctcctttttatcctcccttctccactaccctttttagcttctgctaaccatcattatacctctacctccatgagttcaattttttttagctgtcccatagtagtgagaacatgtggcctttgtcttcctgtgcctggcttgtttcacttaatgtaatgtcctccagttgcaactgtgttgtaaatgcaggatctcattcatttttatgactgaatagtactcctttttgtgaattttctttatccattctatccacattttctttatccattcatctgttgatggacagtcaggttatttccaaatcttggctactgtgaatagtgctgcagtaaacataggagtgtggatatatcttggatatactgatgtcttttctttggatatatacggtgggattgctggatcatagggtcattttatttttagtgttttggggaacctccaaactgttttccatagtggttgtactgatttagatttccaccaagagatatgtatgagagttcccttttctccacattcttgccagcatttgttattgcctgtcttttggataaaagccatttgaactagggtgagatgacatcttattgtagttttgatttgcatttctctgatgataattatgttgagcactgatatggtttggatctgtgtccccaccaaatctcatgttgaattgtagctcccaatgttggaggtggggtctgctggagggtggttggatttctcatgaatagtttcatactgtcctcttggtgctgttcttgtgatagtgagttctcatgagatttggttattcaaaagcgtacagcacctccccgctcactctctcttgctcctgcttccgccgtctaagatgccttactccctctttgctttctgccatgattggcagtttcttgaggcctctccagaagcagaagctgctgtgcttcctgtacagcctacaaaactgtaagccaattaaaactcttttctttataaattacccagtctcaggtatttctttatagcagcgtgagaatggattaatacaagtctcaggtatttcttttcttttttttgagatggagtctcactgtgtcgcccaggctggagtgcagtggtgtgatcttggctcactacaacctctgcctcccaggttcaagcaattctcatgcctcagcctcccaggtagctgggactacaggtgcccagcaccacgcctgactaactttttttgtatttttagtagagacagggtttcaccatgttggccaggctggtttggaactcctgacctcaggcgatctgcccgctttggcctcccacagtgctggggttacaggcatgagccaccgtgccatcaggtatttctttatagcagtgtgagaacggattaatactagcaccttttcatatacctgtttgccatttgtatgtcttcttttgagaaatgtctattcaaatcttttattaattttaaattggattattagatttttttcctattgagttgtttgagctccttatatttttttgtgaattattctttgtcagatggaaaacttgcagatatttattttcttccactctgtaggttgtctcttcactttgttgattgtttcctttgctgtgtagaagcgttttaacttgatgtgatcccatttgtccatttttgctttggttccctgtgcttgttgggtattactcgagaaatctttacccagtgcaatgtcctggagagctttctcagtgttttctttagtagtttcatgtttgaggtcatagatttaagtctatgatccattttgatttgatttttgcatatgtcaaaaaataggggtctagtttcattcttctgcatatagatgtccagttttcttggcattgtttattgaagtgactgttatttccccagtgtatgaatgttcttggcacctttgttgaaattgaattcactgtagatgtatgaagttgtttttgggctctttattatgttccatcggtctacgtaacttgttatgctagtaccttgttgttttggttactatagctctataatacgatttgaagtcagataatgggattcctccaattttgttctttttgcttaggatagctttggctactctagatcttttgtggttctgtttaaattttagaattgttttttctgtttctgtgaagaatgtcattggtattttgataggaattgcattgaatctgtagattgctttgagtagtatgaacattttaacaatattgcttcttctaatctcactgtgtcgcccaggctggagtgcagtggctccatctcagctcgctgcaacctctgccttatgggttcaggcaattctcccacctcagcctcccaagtggctgcaactgcaggcgcatgccaccgtgcccggctaatttttgtatttttagtagagatggggtttcaccatgttggccaggctggtctcgaattcctgacctcaagtgatctgcccacctcggcctcccatagtgctataattaacagtatgagccatcaagccctgccgtatttcattgtatgaacatattacagttcatttatccattcacttgttgaagaacatcttggttgcttacaagatttggcaattatgaataaagctgctataaacatctgtgcagaggtttttgtgttgctatatgttttcaactcatttgggttaataccgaagaacatgattgctgtagcacatggtaagaatatgtttagctttgcaagaaaccgccaaattgtctttcaaagtagctgtgtcattttgcattcccaccatcaatgaatgacagttcctgttgagccacctccttgtcagcatttgatgttgtcagctttggattttagccattctaataggtgagtagtggtacatcattattgtttcaatttgaaatggctactgacatatgatatggagcatctttccttatgcttatttgctatgtgtatattttctttggtgaggtgtctgctcagatcgtttgcccattctttaattgggttgttttctattgagttttaacagttctttgtgtattttgaatgtaagtcccttatcaggtatgtcccctgcaaatatgttctcctagtctgtagcttgtattgtcattctcttgacaattcttttgcagagcagaagcttctaattttaatgacacagaacttatcaattgcttctttcaaggattgtgcttttggtgttgtatctaataagccatcaccaaacttaaggtcatctagattttctcctacattatcttctagaagttttgtactcactattcatttaggtctacaataaacttggagttaattttcgtgaaagccgtaagggagcttctaagggggacacacactaacttctttgagagtgggcagtgattgtgaaactctcagctgggtcttacaacagaccccagatccatcaggagagcccagccttcagaacccatagtggaatatgtttcatgcatacacggaggagaatatgcagtcatatgctcacatgcatgtctgaacatgatcacacacatgaatatggctatgtcctgatccagagttctctcattctctgtaagtgattctttccttcaacttcttcattaagggatatattgacagaatgtcattaaaattaaaaacttctgctctgcaaaaaattgttaatggactgactctgtatgtccattcatgtctcgttgtgtccctggactgactctgaatgggctacagtggccttatctggtagcaagcacagattacacccgggtattcaaagcatgttgagtaggtgagagtgtgggcatgtgtgcagtgaaggcaggacagccacccgccaggtctctggaaaactccccaggacagggatgttcaggccatgtgatgctatactaagctgttttacgtgaggaataggtgctttttaagaatctgtctagaaggctatgggcacagatctgtgttcaaagattttctgggcacttatgttttgtgagacatcagagacaactttctaagcctcagttttgtcacgtgtaaaatgggcatgaacgcccttcgcagaggtttgtggcaattaggtgagcgtgcaatggtttttgaacaaaggtgacacgggggtacgtgctcaggaaataagagctgctattattactactcttcatagcataatgtaagggtttccttcctctcatcccagctcggaagcaccttatcaaggtgaactgagccgcttctgtttcttctcttccctctagccaccacgccccttcctttccgccatcctgcccccagtcttagctgcgcccctctcccaagcccggtcttggccctgccctttccctggccccgcccaccagacctgcaccggcacagccctcgctcagcggggcaggaagctcatggtgtagtttcgtgggatcgtggcaaagcccacgtgtttgggggacacgtcaatgtccttaggtgactgggaggacttgaggcggaagttctgcatgacggtggtgaagaagagaaagagctccattctggccaggccttctccgaaacagttccgctttcctgaggaggagaggcgggaggggtggaggtgaagcccactctcagtgcagcctcgccccagtaccgacctccagctgcggctctcccagggaggaagggtggaatattatggcctgagagagtttcagaggaggctctgatcctccctgagcctcaatttctttctataagagatgtaacaatggtgaaccaatattgatatattattactaacaaagtccatagtttacattagggtttactctgtgttatacagttctatgggttttgaaaaaggcataatgtcacacatccatcatagatggggtgatccatgccaggtgtagcaatgggaggtttagatgtcctttcctgccaggtacacttgcaaatatgactgctgtgccgtcatctcctttttagggatctgaggaatctgctgtgtgaccctagagaaatacatctacggggaaagatgtttcctttcattttacctgggcgcaggtactgggtgcttggtagttaaggaagtatcagctgctggctcaagggtagattctaacaggaacttccaagctggagaaataccaggctacaccgcagagaggggaggagggtgagggaggcccctgctggtgtgagccgtggcctggcagcaaacagtggtctcttaccgatggaaaagggcacaaaagcatcactcttcttaaactgccccttctcattcaggaagtgctggggattgaagtcctgggggttggagaagaaactggggtctctcagcacagagcccagcatagggaacacttcggtgccctggtagggaggaggaagttgtgtgtgatgaggagggtcgggggattggtgaaagtacacaggggctggagggggaactagtgtgccccaggtaaggggaagtggcaggcatggaggagttggggtcctctgatggaggagctttgggggatagaaggttcacatctctgaaacaggaagtttgggagacatggggtccatgtccttctaggcaggagtttgggggacctgagatttctgtccctatgacaaaaggccgaatggaaagggggcttctgtttcttaagataggaagtttgggaacatgtgtttgattctcctgacacaaagagtctggagagatgcaggactcaggagtgtctaagtggaaaggtggaacggatgtggtggttggggaagtcttttttgactgattgagggagtgggacagggtctagaaagcttctaatgtgggtgggatgctggggacacagagaggggctggaagtccccgtagtctggggggtgggggcggatagcaccttagggaggaagaaatcccgaaacttggtgtcctttttgactctgcgggccaaactcatggggatcacgtctccaaatctttggatctcgtggatcactgcctccatgtagggcatcttggcccggtcctcaaacttgggctgccggttcttgccgatcactctgtcaatctcctcatggaccttggctgggggaggagggggaatgtgtttaggtatctaggggtctcagagcaggaaatgatagtccgaataggcaaaatggggtggatgatatggctccgcctatgagacggaagtagagcattcataacagaacagacatcagccattcgcattgttggagtaggatcctgttaaccaggttgtgccagaatcacaggggaggcacagggaggaacttaggggatgacccggtggaacgggcagtgggcactcagtgggcttgggacagaagtgactgaccaatcagtgcagacattttcaatattttaatatctaatgagactcagctgatgcctaccagctgaatgttgccctgtctctggacagcaagtcacgtctcagggtcccgggatctgggacaggtggggacattgcaccagtcgaaggggaattttgagggtctggggccctccacttccgtccccctccagccttaccctccacctctgggtgcttcatgagcagcaagaagccatagcgcagggtggtgctgacggtctcggtgcccccaatgaagaggttcaacgtggtcatcaccaggtttttcaagtagaactccgtgttggggttcttctcctcctgcagggagagggggctttaggccaacctcactcctcttgccctcagggcccttctagggcttttcctttggatctacctctctttggttcagaccaaaggtggaaagagggaccctagatctaccagactcgctctaggttccagcccttgccctggctgctggctttgcccaaaatgctcttccttctcaccttctttaccttgctgaccatctgtccttcaattatcaacttagctgtcagtttttttttgtttttttttttcttatactgacttggtcttgctaagttgcacaggccggactccaactcctgagctcaagcaatcctccagcctcagcctcctgagtagctggaactgcacatgcgcatgaccatgcaggctcacttactttttaaacaattaattaattttttttgacacagggcctcattctgtcacccagactggagtgcaatgccgtgatcttggctcattgcaacctctgccccccttcgcgccaccatgcccaactaatttttggatttttagtagagacggggtttgaccatgttggccaggctggtctcgaactcctgacctcaggtgatccacctgcctcggcctcccaaagtgctgggattacaggctgttagccacggcacccagccaattgtgaggattattatgatgagggttaatttgaatgggcctgtgtcatctgcctgccccactcccagactgatttccctctgcctggctttgcatctccccgcagtggctgctggggtgtacctcctgcatgcggatgagaaaggagtcaatgaagtcccgtggggaattgggatccagcgtgcgctggttgtgctccaccttcttggctatgaagtcctccagcccttgcagcaactgaaaggcctgttgctgtggtcctggcaggtgtttcatcaccgaagagaacatctcatagagctggggttgcagagagaggatgggaagggaaggacagctgtcacggggcaggagctgatgggaatgggatttgtttcatagcaaggaaggaactgagttaaaggcatctgtctcgttgtttaggtatttcagtggggccggataggaacttatatctaagttttcaggaaggttaggtaccagggccacggtctagtaatttaggtgagaagaactgagacatatatccaggtttcaggtatttaaacgaggctggattggagcacacatctaggtgttcagatattcaagtgaagttgagttggaagacacctgtccaggtgtttagctcttcaggtggggctggtatgaggtgagtgtcacctgtctaggtatttaggcattcaagtaggcttggttggagacagctgtccagatacttactgggtctggattgggggcttttgttcaggtgctcaggtattaaagtggggctggtgaagatgttgaagtggaggggatacctgttgaggtgtttacctatccaagtgggatgcactgggagcacctctgtaaggtgtgtgattggaaagggttggggaacacttatttgtgtgtcagggaacaatctgtctagatatttatgtgtttaaggtgttggttagggcagctgtccatgttttcaggtatttaagtgggtgaagtagagggcgcttggccagatattccagtgggctaatctgggacatttgtgtagatgtgaaatgattatgatgggctggattttgcagcaccaggtgttcaggtatgcaggaggccggttgacgcagtcacttgtccaggtgttaaaatattcagaagaactgggtagggagcatctgttagaaattacggtaagttggggatgggaacacgtgcccaggtgagagagctgagctgagggtatgcatcctgccagcaggctctgttttggggagcatctgttgagctatccaggtgtccttggagacagggtattggacatccatcctgggttctggtgcaactgtccagttgtccaatatcggggactgattttgaggggacactgtctggagggcggtgggagtttggggcacctgtctccaggtaggggagcagttggcaggttgtggtaggggcgtcacgggccgggctgcagccagttacctgccccgtggaggttgacgtgaactggaagattcctagcatcatgcgcaacagtgacaggaactctttgtccttatagtcaaagcggtccccaaagacaatggagctgatgacattggagactgtgcggctcaggaagaaggtgggatcgatattggcgcctgcgggtatggcgggagaagggggttggggagagagtcaactcagaggtctgaggagagtcagaattccaggaggcagggccttgttgagccaaattcccagcgccagactccagggctggaagtgcgggcgcctttccccacctagtccccatccccaggcagaacgcgcgcgggttcctcgtcctgggtgttttccttctcctgcccccgcactcggggtcccctgctcaccgccagtgccccggagggcgtcgatgaggaagcccgcctcctcctggatgcgctcctcgatgcctcgcttgcccaccccgaagtcccgcagggtggcgatggagaagcgccggagctgcttggcgcgctccccgttgctgaataccacgcctggggaggtgaacgcgggaatggagacaggccagggggcggcaggggcaggagcggagcagctccaaggggctccccaagggtggaggagagagggagtagggtgggagagagatggattcagcgccattgcccagcagagctgcaaactcagtcagagaaacacgatgtcgaggtagagagagagagagagagagagagagagagagagagaagagagagaggagagagagagagagagagagagaagagagagaggagagagagagagaagagagagaggagagagagagagagagagagagagagagagagagagagagagaccaggtttaaagaataagacaatcagaaaagaaacagaaaggccagacagagagatgcacatagaaacagagggataaggggacactccatggaggaagggaaggaagtggggagagaaagagagtgatggaggaagaggatggagggaggggaagtgagatatggggagatctgggaggaggaaataaaaatggtgaaagattcttaagctgagctggagaagagagaaaaatattgagatagaaacagagagggtctggaaggaagagagactgttaccaggagatggaggctgaagatgtggaagtaggaataccctgaaatcctaagacagaggaagaagtgagaaagggatgcggagagatgagaaacacagagaagcccagaagctaagagggacaaaaagacaaatgaagacagagaaccagggctggaaaacagaaacccaggatgtccttagagatggagagagaggggaaagaggagactccagtgagagagaataaggaggtggggcagagagaggcagggaggaatcaggacagggacgctggagacaggtgagggatacacatggagaggccacaatgaagggagatggggagggaagaccagactggggactctgccttagcctccagttggcaggagagtcagggagaaggctgggaacactgagaccttcgtgtccacctggccaccttccccctcttgggcaccccctcaccatagcctttgaagacccagtcgaaggtggcttgctcgcctcgcccgctgaactcctcagcctggtccaccagagcctccctgacggcatcatgtccacacagcaccacgacccgccggggccccaagtgaatggtgaacacggggccatagcgctcactgatctgatggaggtgggtgggagtggttagagggagaagcctccactctgaatggggcccagcaccgagatgtcatgtgctgggatgcttcgcacccaggttctcacagtcagggagctggacatcccaagatcctgtctttctgatgctgaaactccaaaactccatttcctaagactctggtccacactggtcaaccccctgccacaaagccccagccaactaggcagcccccaccccgtgccacccatctccctgccttgggacaccttcatgagggagttgtacatctgctctgtgttcagctgcaggtagtttccaatgaagggcaatggggtgggtcccggaggcagcttccccttgctcttcctctgctgccaaacagacatcaagaccattacagtcaggcagaccagcaaggccaccagaagcatccctgaggccagcatggtggtagtgggatgatagatggtgacggctggggtggtttgcctttatactgcctgaaaaagagggatggactttggctgattacataattacctcatttcacctcccaactacatgccccaccatgaatcctgcctagcttgggacacagccagcaagggaggataaggggaccccagggcagctgaacagagagggggcctccagactaaatctgtggtacttcaggaggggtgccgcagggctgtggatttaggagggggcaacagataagctgtagaactgaggagtttggaatatttgcataggggagcacttgggctttggatttggggtctgagagtgagaatgcaccccaaagttgtggatctgggggttccaggggagaggaatccaaaggtctgggttttattagggtaagacaaagtgtggctgtgcatttaggggtcttctgttgtggaggatgcagggttaagggtctcaggaagggggattccaggcatatggacttgaaagtctcggggctaggaagacccagggctgtgggtgtggagtttctgggaggaggagtgtgtagcaagcccagcgggttctcccagaaagcccagcagcccagcactgggtccaggggctgacttgattttgcttttgcccagagctgtctcttgatgcccagaatcctcattggaacctcagagtgaggccaggatgggtgccatagaacctccactgcccatctctgattgggaaggggaggaagaccagagccatatttcaggggaactttccccacacctggagaagagtacctggagttagcggttggcagagggattggctaggtctggagaaatagtaataacaacccccaaatggtggaaaaatctcaagtgtcccaagggttgtccgctggtttccaacccagatcctcagggaaacccactagattgattgtatcatccctattaatattatgattgttgtttatgtttctcattttatataaagatctacagaggacagaaaacagacagtgggcaggggacatgtgtgagtggccctgaactcccatctctcctgctctgtgtacttagttcccctttctggatttggttttcctgccagtggaaagggagtgtttgggaagagaagatcacattcgagggtgagttaagtctcctttaagaatgattcctgctttgtcaggggctactactattagcaggcagagggaacagtggcagaagagattggggtaaactccagtattaggcacagaggcagatcctggggtgggtgtgagtggagaagggatgagtagccctcctgtccttccctcagggaaattcttccttagtaaacaggacagttaccctttggtgagcatggtcgtatacgggaagattaagtctaggtgtgtatgatctggttgaatctttgtaacaatgaggttggttcatcatgatcatcctcattttgaagatgagcagatctagactccataaatcctcttgagtgaggtcacacagggagtaagtgagggagctgggatgtgaactttctcctcaccccccttcattgactggcctagatcaccctgggagtcaagtgcaggccagccttagcaggaggtgagtgctgggactggcatcagcagtggacacactgatgacattggtgggttctgatatcagcatcaggtatggccagggagggaaaggcatcgtgttggctttgggactgcccccaggtgtatgcgaggatgggaaacaagttggcactgaacttgacaccaggagaatattgaagtcatgtttggtgccaagagggctctgtgtgttgtctcaggtgtcattgagggcataagagtgtcctgcttcaggagggcgtaagggtggcaccatatagggtctgaggttggtcccagtgggctgtgacatgagcatgaggcaggtgctgatattggtcctatgtgggtctgagatgagcctcagccagaccctgagaggggccccagatggccacaggacaggctgtggtggttggaccatttagggttgcacctgtcctctgggtcaccaactttggacaagtggaggtgggtgaggttggcacccccaggactgacatcttgctcaaactgttctaggatgctgagctctgagacctgtgtggagggaacaaaggtcagagaacaaggcagagagaggaaagttgtttgttgattttggaggggaagaggtgggaaggaagattagcaccagcttggcagatatcaatcgctctaatcctgttcaccagtctgcacctgggcctggctcctccttttccttcgtgtttcttaaaaaggtgggagacagaaatctggggagtttgtttctcactggggttggcactaggaagtgcactgagtgatcagcaggttgccatgacctggccagggaggggatggggagagacaggttgggagaactctagtatttgtggacatagaggtcaatgaattttggacttgttgattaccctagagcatggagtgagagaatggtgtctgaaatcatgtgggagggacttgtcccagtgggcagtgtcttgggaacaggctttcagagtgagttagtggcgagcccaggaagatccctttcctttgctgggcctcagtttccctttctgaatggatggtgcaatgattaaggcctggattggaatcctaaccttatcctttctttgttgtgtggctttgaacagctgacttcatctctctgagtcttatggagccaagaacagctcctacctctttggctatttaggggagaagtataagtgttaatgcagatgaggtacatggcagtaagtgctcaatgaatggtagttgttctctttaatctgtaggatgaagcggatggatgagatgttccctaagcacattccttgcttttacattctctagtctaaagctcacaaatcttttcctttgggaaggaggaaagggacagagtctttgggaacctccttcgccatcccttcctcagcacagccaagctttaccccatggagctgtgaataggaaattaatccttcatggcctcctggagtgtggtgctgagttaggcagtatctgcggaaggacaggccagcattagactctcaggttattctggttggccctggagccctgcacaggactttgcccacctgtctgtctatgcttgtcttggatcccatctttctatctttctctttctccttccctgcaagtcagtgttcccctcaatcaccctgtgtgctcatgcatctttgtgttttgtgccattttgtccagtgggttctcctggatgcctctgccatgtttatcctcatttatacaactgtgtgtgtgtcattctgggtgcatgcttttagtgtctacgtgtatgtatgtttcagcatgttcatgttgatacatgaatttatgtgtgcaccaggctttgtggtgtgtatgtttgtgcttgataatgggtatccattccaacttatgtctgcacatgcacatgtgtgtgtgtgcctgacagggtgtggcactgtttctcaatgcttgccaatctttgtgtctgtctctgcatacagcatgtgtgcacacatgatttaggggtgtctacgatgtgtatttctgtgtagaacaagatgaatgctgcatattcatatttgtgtgtatacattcacaattgggtgactacatataagtatgtggatgtttttttctttgtttttttttttgagacagagtcttgctctgtccccacgctggggggcagtggcatggtctcggctggaacctctgcctcccaggtttacaccattcatctgcctcagcctgctgagtggctggggctacaggtgcctgccaccatgcccggctaattttttgtatttttagtagagatggggtttcaccatgttagccaggatggtctcgatctcctgacctcatgatccgcccgcctcggactcccaaagtgctgggattacaggtgtgagccaccgtgcccggccagtacgtggatgttttcatgtgttcattctggtgtgtgtgtgcagacttgtgggccatgttgcatacacgtgaacatgtgatattttcctgtgctcatctgtgtttggattaaaacagtcctatcccagctccatttatctgcttgaaaaaacccccagaactgcaggaagctttttatgagcataatcttaattgaactcctgattgcaagactgaggttagctttatcatctccattttgcaaatgagttagataagttcccccaaagccggtcataagtgacttgcttctgcatttcacagctaatgagtgtagagtcttagtatggtcttgtgtgatggtaaattttttttttttgagatggagtttcgctcttttgctcttgttgcccaggctcgagtgcaatggtgcgatcttggctcactgcaacctctgcctcctgggttcaagtgattctccagcctcagcctcccgagtagctgggattatagccaccagacacagctcatttttctatttttagtagacacggggttcaccatatttgtcaggctggtttcaaactcctgacctcaggtgatctgcccacttcggcctcccaaagtgctgggattacaggcatgagctaccacgcctggctgtgaatgtaagtttcatgctgttaatcaccactttggactgctaggccccacctgtttttctttatgaaacattagaaaaactgcttgtactcccttgtatttcttcaaatacttccgtgtaaacatgtaacaaaagatttcaaaatgttagaaaaaaaaagtcttttaataggagggagacttgaccttctatagtgtttgcactctttggaaccttaagcaaagacctagttggccagtatagccctcatgccattggcaatgaagcagtgggggagttggggtattagtggttgtggtcagagagtgaaatgtctgtgtttcacatttcagattgatgacaaggatttggggggtggggctgtgggaatgttggctgaaaatagagtgaagaaggtcaaagaagagaagacagtcaagattctttttttctgagtgtttggatagctcacatccatggccatgaagttcctccctaccaggaaaatggcaggacttagagttcagagatgggacatttagtaaatagtgctacaataaacatgaaagtgcctcaacatactaattttttttttgaggcagagtctcactctgttgcccaggctggagtgcagtggtgcgatctcagctcactgcaacctctgcctctcgggttcaagcaattctcctgcctcagcctcccaagtagctgggactatagacgtgcaccaccatgctgggctaatgtttgtatttttagtagagacagggtttcattatgttggccaggctggtcttgaactcctgaccttaagtgatccgcccatttggcctcgcaaagtgctgggattacaggtgtgaaccactgtgcccggccagctacacactaccagatctcacgagaactcactatcatgagaatggcaagggggacatctgccccctgattcaatcgtctctcaccaggcctctcttccaatattcgggattacaattcaacatgagattggggtagggacacagacccaaactatatcaccttctctgtggtaggttatattgttttatatttttatttttttgagacaaggtcttgcttcatcgccaggctgcagtgcagtggcatgatcatgggtcactgtagccttgacttcctgaggctcaaatgatcctcttatcctcttatctcagtctcccaagaagcatgccaccatgcatagcacattaaaaaatttttcttgtagagagaggtctccttatgttgcccaggctgatcttgaactcctgggatcaagtgattctcctgcctcatcctcccaaagtgctaagattttagacatgagccaccccacccagtgattatattgttttatttatttatttatttattgagacagaatcttgctctgttgcccagactggagtgcagtggtgtgatctcggctcacagcgacctccacctcccaggttcaagtgatacgcctgccttctgctgctgaatagctgggactacaggcgcccaccatcacgcccatctaacttttgtatttttagtagagatggggtttttcgccttgttggccaggctgctctcaaactcctgacctcaagtgttctccccaccttggcctctcaaagtgctgggattacaggggtgagccaccacgcccagcttatattgtgttgaaaatgttttcttctctcccactggtcctttccttaggtaagaattacactttcctctaccccatggacaggcttggctgtctacttgctttggccatgactcctatcaactctttttctttttttttttttttagacagagtttcgctgttgtcgcccagcctggagtgcaatggtgcaatctcggctcgctgcaacctccacctcctggattcaagccattcttctgcctgagcctcccaagtaactgggattacaggcacacgccacaacgcctggctaattttctttgtatttttagatggggtttcactgtgttggtcaggctggtctcgaactcctgacctcaggtgatctgcccgcctcggcctcccaaagtgctgggatgacaggcgtgagccaccgtgcccggccaactctgttttgttttttttttttttttgagaaggagtctcgttctgtcgcccatgctggagtgcagtggcgagatctcagttcactgcaacctccgcctccagggttcaattgattctcatgcctcagcctcctgagtagctgggattacaggcacatgccaccatgcctggctaattttgtatgtatatgtgtgtgtatatatatatatatacacatatacctgtatattcagtagacacggggttttactatattggccaggctagtcttgaactcctgacctcaactgatatgccggcctcggcctcccaaaatgctgggattacagacatgagccactgcttccagcctaactctgttttataccaaaggtctcactgggctccagtaactacttcctccatttccactctcagggatggggtggcaatggagccccactgttatgggcttccaggatttcccttaatgctgccctcaactttgtaaatagtcctatcattaaactctcaattatcctgtttgtgtatgacttatcattcctgctgggatcctaacccacacagcacttcattgtatggatgaaccatttatttagccagttctttaatgatgaacatttaggtcatttccaatctttcactattaaataaaactgcagtaaataaacttgtatataggtgatttttcacatagtcaaatacaactacaggataaattattatatatggagttgctgaatcaaataatgctgtttaaaaataattttgactgatattgtcaaatcatgtatagaggtgtacagccctattagcagaggataaggatggggacttttcctttggagcaagcccagaatcctgaatgttccaacagctgaagatgaggactgctaagagaactcaaggtaaagaacattagatttctggcaaataggtgtaggtgggtatcttgagtaattcattgaataaatgaagtgtgtaactgtgtttgttccccatcttggaatttttaaaaattattgcttttagatggagtctcactctgtcacccaggctgtagtgcagtggtgagatctcgcctcactgcaacctccacctcccaagttcatgcaattcttgagcctcagcttctccagtaggtgggactacagacacacaccaccacacctggttaatttcttttgtatttttagtagaaacggggttttaccattttggcgaggctggtcccgaactcctgacctcaagtgatctaccagccttggtctccccaggtgctgggattatagatgtgagccaccgtacccagaggatattgttgattataattgttacagaagttttcgaaggtttgtattagaaaatgttaagtctcagaggactgtcttagttcattttgtgttgctataacataataccagagactaggtaatttacacagaaaagagacttatttggcttatgattctggtgactggaaagtccagagcataatgccagtgtctgcttggcttctgtgatggctttcatgctgtatcataacatggcatgaggtcgaaggggaagtagacatttgtgaagggtcaacacatgagcggtgtcctcaatttataacagtctgcccttgaaggaatgaatccattcccatgagaacgaatcctgttttgcaaaatgagacctcactcactaccttgagaaaggcaacaagccacccacgagggtggagctcatgtgacctatgtgcctcccatcaggcctcacctcttaaaggtttcacctcccagcattaccgaaccgggaattcaggggttccagcatgaattttgacaggaacactcaaactatagcagaaactatgaccctacagatagtgattgtaatatttcaagtctttggtatagagactgtaatttccaagatttcatgaatctttctttcatacatggaaggctgggtaagtcaaagattttcaaagattttcagcctcctcccaagagacagtacccatgcatggttagggtctgaatgagcaattgttattcaattgtttgttatgaaatatgacatgtggcttttgggtttcttgctactctcttatgcctcccctcagtcagtgggaagcagcccaaactggaattgaagctgtcaacacaaacctgaaaatgttcagaacttgataactatagtataattataaatcgcacagggccctggtagttaaatcacttcacacttgactttatttgcctgtctgtagaataaagagcaggaaagagtcaaacaagatatggtttgagtcagagcactgatactttttgtagctgtgtaactgtggggaggtcagtcaatgcctctcagaatgaatttcctcacctgcaaaataataataataatgacaataataataatgatagaaatgtactactttgatgcactgatgtattacagaaagaaaaaaaggcaaattttgtctttaaactctcagtttaaatcagtaaactagataccttttttttttttttttgagacaacatgtccctctattgcccaggccagagtgcaatggcatgatcataactcaatgcagccttgatctcctgggctcaggggattctcctgtgtcagcctccccagtagctgggattacaggtgcacatcatcatgaccagttaatttttaaattttctgtagaggcgagatctcactatgttgctcaggttggtcttgaactgctggcctcaagcaatcctactaccttggcctcccaaagtgcttggattacagctgcaagtcaccgtgcctggctgaactagagtgcttctatctaatcctataggaatcccttatttcttattgctgcaggatgaaaattaaacacagattttaattgtgtggattgaagaattatatcagaagttgaaatcacatcctcaccaagtcttatatgtgaaagttagggcattggttgggaaggagaggaaccctgatacttcgaatggggatatctgggtagcctcagatgaaactgagtcactctgagcatcctttctgaatgaatgtatcttcccctctcatggtcgaggacactagttttctctttcttataataacaggggagttatcttgaaatgggcagtatattctcctcaatactcaccttgtttatttatttatttatttatttttgaggtggagtctctgtcacctaggctggagtgcagtggtgcaatttcagctcactgcaacctccctcccaggttcaagcgattctcctgcttcagcctccgagtagctgggattacaggtacctgacaccatgcccagataatttttgtatttttagtagagacagggtttcaccatgttggccaagcttgtctcgaactcctgacctcaagtgatctgcctatttcagcctcccaaagtgctgggattacagatgtgagccaacatgcccaacctcaccccatttattattttctgtctacagatccctaattagagtcagatcgcagcatattttgggtgacaagtacaagtatgatcttggagataatagcatatactccaaaataattgcaatgcttcttgtattttgcataggctgaaaccaaagttaatagaaatggtaatataggctgagcacagtggctcatgcctgtaatcctagcgctttgggagaccaaggcgggaggttcacctgaggtcaggagtttgagaccagcctggctaatatggtgaaacctcgtctctactaaaaatacaaaaattagctggacgtagtggcacgtgcctgtaatctcagctaccagggaggctgaggcaggagaattgctggaacctgggcggtggaggctgcagtgagccgaaatcccaccactgcattccaacctgggcaacagactaagactccatctcaaaaacaaaaacaaacaaacaaaaaaagaaatgataatatattataagggtgttagatcaaggagaatagaatataatattagattgggctgaatttgtagatcgtggtatacttaaccagaaattctggattgagtatgttagctcaggcagctttaaatggctctaagaattgagataggtgttgagagaaacttggtctcaagagtgactttaaagtcaatgaacttgagatgccacaacttcatcagcattgttcagaggaaggaatccagaagtttggagagataggaatgttggagtgggtttattgtgtgcaaccctctctgtattgcctcacccactagatcttctatgagtgctcatcatctctcttcatgaaggtcatgaagagaggtctacattaagaacttttgggcttggccaatggaaggttgagagaagagcaaggtcagattatcgtgcctggccatgtgataacagtggttgtattcctctgccagaaaccatgtcctcctgctggaggctctcttttacccctatacagtcagtctcagtttcagaaacttgtccctctcactgcacctttccacctagggatgatgatggcttatccttactgtaagccatagagtgcttcaacatcttgtaggtttccttcacactgccctcaactttgtaaaaagtccctccattggccaggcacagtggttcacacctgtaatcccagcactttgggaggccgaggcgggtggatcatgaggtcaggagatcgaggccattcttgctaacacggtgaaaccctgtctgtactaaaaatacaaaaaactagcctggtgtggtggtgggcacctgtagctccagctacttggtaggctgaggcaggagaatggcatgaacccgggaggcagagcttgcagggagccgagatcgcaccactaaactccagcctgggtgacagagcaagactccatcacaaaaaaaaaaaaaagaaagaaaaaaaaagaaaaaaaaacccctctattaagcactcatattttcctgctgggattctgatgcacaaagtctatcaaatgaatgcatcataatttgtttaaccaatatcttggtgcacattttggtttcccgttttccattatgtaaacagttctttgatgaatctagatgattttgcacactgtcatgtacatcgtaggagacattactagaagtggagttaactgagtccaagagtatgttcttttgtaatttagacaaaagcgttcacattactctcctctgaagctgtaccaatttacagttccaagaaccgtaactgagagtaaggattgctctgggaggctgaggcaggagtggataccagcctgggccacatagcgagacaccacctctacaaaaatatttaaaattttttctactactagggtgtagtaccctagtactgcctgtggtcccagctgcttaggaggctgaggtgggaggattgcctgagccagggggtcaaggctacagtgaattatgattgcaccactgcattccagcctgggtgacagagcaagacattgtctcaaaaaaaacaaaaaaacccaccccaaacaaccaacaaaacaagaggccatgttttcacacccagtgatcttaatagctcaagttttgctttagagactgtggttttaacatctgctatagtcctgatgctgaagaatcatggagtcaaaggtttcagcctctttccaagggggagagcacatggacaattaccatctcatgcaggcatttggttttatggactcacatgcttgttacaaaaccagacacagctttagggcttgttattaccttcccccaacccatccttggtagaagacagtcaacaaatgatatctaagctgccaacacatattggaaaatgtttgaaacttgagatctgtggtttattatgaaacacgcagtgccctggagtttgaatttcttcccggttggtcttagtaccctgtctacagattgaggggaaagggcaggaaggggagtaagtgtagttaagagcatagccttggccaggtgcggtgtctcacgcctgtaatcccagcacattgggaggccgaggttggtggatcgcttgaggtcacgagttcaagaccagcctggtcaacatggtgaaacccccatctctactaaaaatacaaaagttagccaggtgtggtggtgggtgcctataatcccagctactcaggaggttgaggcaggagagtcacttgaacccgggaggcagaggtttcagtgagccgagattgtgccactgcattccagcctgggtgacagagtgagactgtctcaaaaaaaaaaaaaaaaaaaaaagagtcaaacagatctgactactacatctgtgatctgtgctaggtcctttcagtggttgaaccttaatggttgtgactctctgtttgctcatatgtaaaatgtggatgatcatagaacctttatcacagatttgtgaagactgcatagcacactccatgaaaagttctccttagcacagcatcaggcacagggaagctcaacgccttgaaggtgctgtttttatttctaggtccctaagatcttcctcgtcctccttatggctcccccctttattctccatatttgttccttccttgaaagtcaagggtgcaggaagaagatgatatcctggaggccaagcccacacaattaggacatgtagtggacatttacctgttcttagatccactgctgctcttcctctgcttgtctatcacaaggggctgacacctgcacactaattctgtcttgagggagactgtgtaggggaacatggccatttgagttcattaggaaagggttttgaggtcaggacatgggtatttggtgtacatgggagtttggtggcctctattgtaggaggctttggaaatgtgtattgttgggaggtcctgagggaggaagtttgggatgaacatggagattctaggctgtggaggaagatgtaacatggctattggaggattctgggaccttaccttggtaccttggtaatgaggacatcttcagctttatttttatgtatttacttttttttgagatggagtctcactctgtcacccaggctcgagtgcagtggcgtgatctcaaaatactaaaaattagctggttgtgttggtgggcacctgtaatcccagctacttgggaagctgaggcaggagaatcgcttgaacctgggaggcagtggttgcagtgagctgagatcatgtggctgcacctcagcctgggtgacagagtgagactctgtctcaaaaaaaaaaaaatgttcatgcctcagctgctcagccagtagtcattcttttctcagtagctgttttctcctcagctttgtggagtctttccctcagcctgtgcagctctgtattcagccaatgatttgaggccactgtaagcagctctttccctttggagctctttttgtaagcaaaagctcagtttcttacgtaagaaaacccaattccccttgaggaagagaaagagctggagtcctttaaaattaactgcctgtttttctgtggctagggagccttatctctccctttgccaggcattgtgaagactctgtttctctagctgtgcagctgcaaggtcactagacagataatctcaagtcgtaaaatatgccgttccttgaaaagtaagaaatgatgtaatgcatgtctcaactggataagtgtctttgtttctcgattctgttttatgcttccccctgcacagatctcctcctgcaccagaagtgcttaaaaggtaactggactctttgtttggggctcagtcattttggatgttgatctgactgggccggtgcacctaaataataataagaaatcctcctcaacccctcagtctctctgattcctaaattatctcactgcaaaggcaagataattgcttgagcccaggagtctgagaccaacctgggcgacatagtgagatcctgtctctacaaaagattaaaaaaattagccgggcattgtggcgcatgcctgtggtcccagctactcgggaggctgaggtggaaggattgcttgagcccaagaggtcctggctatggtgagctatgatcacaccactgccttccagcctgagtgacagagcaagaccttgtctcaaaaaaaaaaaaaaaaaaattgggctgggcatgatggctcaggcctgtaatcccagcactttgggaggctgaggtgggtggatcacctaaggtcaggagttcaagaccagcctgaccaatgtggtgaaaccctgtctctactgaaaaatacaaaaattagccaggtgtggttgtgtgcacctgtagtcccagctactcgggaggctgagacaggggcctaggattaaataaggagttttggcaaaactaggctggaactccaaaacctgctacgtaagtactcacgagggttgctagttattagtattattactttgttgttatttttaggagtggagca

SEQ ID NO: 1155 - DNA, 85 bp, Homo sapiens
agttatttgtgccaaattagtaatgtgaatttgggaactatcagtcttttctatggcccggaataatttaaataatagaaattat

SEQ ID NO: 1156 - DNA, 6393 bp, Homo sapiens
ccccaattcacaatcctctacttcctcatcttcaatgttcctacattacactattgtaaatatcccctatttgatattttggtttctagttttaaactattcaaatccatctttcactctaccactagattattctatttaaaacacaaaacatgtcttattcatgtttgaattcctaataattagactggattgttaagacaaatctctctaagaagatctcttttaagatgaaaccaggctaacaattagagccagccatgtagagattaagaaccaggcagagggatcaaataatgcaaagaagaatacaagagtaagcttagtgcgtgtggcaggcagaattttaagatggctctaagattcctactctctgatttacacaccctgtatattaatcctcccctcacatgtcagctcaatctgtgaataatatgcaacatcactcttgtgattatgttatgttacctggccaaagaagttatgtagatgtaatcaagctgggttagctcaagttaatcaaaagggagagtatcctggctgagccagacctgatcaggtaaggatcaggtctgctcacctgaggtcagaaaaattcatctgctggctttaagaaagttagcagtcatgcactgagacagccatgtggctagaatctgagaccagcctcaagttgaaagcaactctcctccaatagtctacaagacaatagaggcctcagttctacaacctcagaagtgaatttaaccaaaaacacatgagcctggcagagaacaactgaacttcagaggagaccacagtcttaaaagacaacttgattgcagccttgtgagaccatgtacagaggacctgttattagtccattctcacaatgctatcaagaaatacccaagaatcgataatttataaaggaaagaggtttaattgcctcacagttccccattgctagggaggcctcaggaaacttacaatcatggtggaaggcaaaggagaagctggcactttcttcacagggcggcaggacagagtgagtgcaagcagggaaatgccagatgcttaaaaagccatcagatctcatgagaactcactcactatcatgagaacagcataggggaaaccgccgccataatctaattacctccacctggtcccaatcttcactcatggggattatggggattaaaattcaaggtgagatctggatggggacacagaggcaaattatatcattccacccctggcccctcccaaatctcatgtcttttcacacttcaaaaccaatcatgccttcccaacagtaccctaaagtcttaactcatttcagcactaattgaaaagtccacagtccaaagtctcatctgagacaaggcaagtcccttccacctataagcctgtaaaatcgaaagcaagttagttacttcctagatacaatgagggcacacacattgggtaaatatagccattccaaatgggagaaaaaggagctacaggccccatgcaagtctgaaatccaatggggcaatcaaatcttaaagttccaaaataatctccttttgactccacgtctcacatctgggtcacactgatgcaagaggtggtctcccatggccttaggcagctccacccctgtggctctgcagggtacagcccccatactggctgcttccacaggctggtgttgagtgtctgccggttttccaggtgcacagtgcaagctgtaagtggatctatgattccgaggtttggaggatggtgaccctcttcttgcagctccactaggcactgccccagtgggaactctgtgtggaggcttcaaccccacattttccttccctactgacctagcagagggtcttcataagggctctgcccctgtagcaaacttctgcatggacatccaggcatttccctacatcctctgaaatctatgcagagattctcaaacctcaattcttgacttctgtgcacccataggctcaacactatgtggaagacaccaaggcttggggcttgcaccctctgaagcaatggaccaagctgtacctttgccccttttagccatggctggagctgaagcagctgcgatgcaaggcaccatgttccaaggctgcacagagcaggagggccctgagcccaccctacaaaaccatacttcctcccaggcctctggacctgtgatgggagggccttctatgaacgtctctgatatgccctggagacttcctccccattgtgttagtgactgacattcagctcctcactacgtatgcaaatttctgcatcaggcttgaatttctccccagcaaatggtttttcttttctattgcattgtcaggctgcaaatttttcaaacttttatgctctacttcctcttgaacactttgctgcttagaaatttcttccatcagataccctaaatcatctttctcaagttcaaagttccacagatctctagggcaggagcaaaatgctgccagtctctttgctaaagcatagcaagagtgacctttactctagttctcaacaaattcctcatctccatctgagaccacctcagcctggatttcattgtccatatcactatgagcattttgatcaaagccattcaataagtctctaggaagttccaaactttcccacattttccagtcttctgagccctccaaactgttccaacctctgccaaagttccaaagttgcgtccaaattttcaagtatccttgtagcagtgccccactctcagtaccaatttaggacccagttaagctatgcctgaactcctgacacacagaaactgagataacaaatgggtgttttttaaatcatgaagtgtgtagtaatctgttacacagcaatagaaaactcatggaatatgtttaagaggcaagaacaacaaaagccagtacaactggggtatggtgggcattttaagataaaaaatgggataaattgttaggagattaggttggcgagatagatgagagtcaaattctgtgaaaatttgttgttaaaagtgggaagttttttataattttgcttgttaagtatataagaaagtcatcactgagatttaagcatgggaagaacctgattggcaatttttaaagaacattctggatgctgtgagtaaaatggattgtaggaggggaataacagaagaaggaatgagactagttagaaggctgttacaataatccggtgagaattgaagaaggctgggatagtggcaaaagaagttagatgtggtcagatagcggtcatattttttaaagtggagttaacaggaattattaatggatcaggttgagggtaagaaaaagagatgaggcccagcgcagtggctcatgcctgtaatcccagcactttgggaggctgaggtgggaggatcacttgaggtcaggagttcaagaccagcctgggcaacatggtgaaatcctgtctctactaaaaatacaaaaattagctgggcatggtggtgcatgcctgtggtcccagctactctggaggctgaagcaggagaattgcttaaacccaggaggcagaggttgcagcaagctgagatcgcaccactgcactccagcctgggtgacagagcaagattctgtcaaaaaaaaaaaaaaaaggaaaagaaaaagaaatgaatcagggatgactttaagtttttgacttgacgaactaagctgatggtgggttgtcgtttattaagcaggggaagtctatgggaggaaccagttggaatgacgggatggggaaaagcatgtgttctacttcggataagttgttttaactgcctactcatcacctgaatggtgatatcaggttagcagatggttatacatgtctcaaactgcaggcacaattcagaactagaagtaacagagtcattggcatgtaggcagtatgtaaagcaaaagtactggatgtattactttgggcaagtgtgttaattgaaaatacaaggttttctgtgcctaatccctggaaaatacaactgacatatttgaggtacagcagaggaagaggagtttgcaaaggagacttaaaaagagcagtcaaggagggaagaataaggaaaaatagtataaagtcatttaaacaaacagaagaatgtatttcaagaaagagaaaacaatcacactttatcaaataatgctgaaaggaaaaaaataaaatacattaggtcagagaagtgatcattggattcataatcatggatatttaaatggtagacttaacaaaagaactgttggagtactggttgtgatggactgcccattaaagcagagacaggacaaaatctaagtgtaaaaaaaccagaaacaataatgacagtagatatctctttcaaaatatgtcactgtgaaagggttcagagattgaagctattgtgttgtgacagctggggtcaagagattttgttttgtatggttggcggtaagatgggatatatcacagcatgtttttagaaagtacattggtatccagcatactattgcaataaaattaaagctgaccttatctgattctacctaactgaattttaatgctaaataaagccaaaactttagccagttcaggatagtcatcatatacatgatggcaaaatgaatgttaaaaaataaacaactacattgagagaagataccaggcatccagagttattcataagttaaatgactggttcctacacactggtctttcaacaaatattttttggactttttttttttttttttgagatggaatctcgctctgtcacccaggctggagtgcagtggcgcgatctcagctcactgcaagctctgcctcccgggttcacgccattctcctgcctcagcctcccgagtagctaggactacagatgcgtgccaacatgcctggctagtttttgtatttttagtagagacatggtttcactattttggccaggctggtctcgaacttctgacctcatgatctgcccacctcagcctcccaaagtgctgggattacaggcgtgagccaccatgcccagcccttttttggacatttttattcaaagttgtgagtaccaataattttctataaaagcattagaattgtcagactatgagatgggcacggtggctcacacctgtaatcccagcactttgggaggctgaggtgggcagatcactgtgtgtggtcaggagttcgagaccagcctggccaacatggtgaaaccctgcctctattaaaaatacaaaaattagctaggcacagtggtaggtacctgtaatcccagctactcaggagtctgaggcagaagaatcgcttgaacccgggaggtggaggttgcagtaagctgagatcatgccactacactccagcctgggtgacagagtgagacttcatctaaaaaaaaaaaaaaagaattgtcagactatggatggacttaccctctattttccaaccatctgtaatatttctatatggagtttcaacaaaaagtaatgacattaaacatgatactgtaaaagataaataaaacctcagctgaccaaagcatcataaatgtaatatcttaaaataataagagcataattatattaagacctacagaattatccatgtctagtgaaacataaagtaacaattttaagactaaaattgtaaagagttaatggttttcaacaaacacataccaaaaattaataattaatttttaatccatagaattttagaccataaaaagatcttacatgttattttgctcaacctattcctagtgccaaacttctttcttcagcatctctgggaaatctatgcttcagcttgaaaatgtccactaagaagctcatgctttctcaaggcaagtacagtggaacagctttcatatattaagctaaaacctgcctctcccaaacttccactcattaatcttagttttgtccttggaatgcatacttagaaagctctgaaattaaaggaacagggtctttacaaagcaaactgtttgctttcaaacttttgttactaggaatatctcaaagtgggggggaaatagtgcttctgtgcttaacaaatgagctctgtttataatcaaaaaagtaaggtttacataaattatttattatcaggaaatccctaaattcagaagtagcctatagaagttgacgttttaacaaattactaaaatcagcttttgttttgttatctgatgtggtcaaagtgttatgcatggctagatacaaatatagcaaaacttcaaactcacttcctcttttcttctaatttaatatttactgattaaatcaaattttaatatgcacttgcttctgcagtagaacagatatctcataaagacaaaactcccactgaacgtagtggtagtcatcagtgctcacagtctaatgtgcactgcaaaaacatgta

SEQ ID NO: 1157 - DNA, 10532 bp, Homo sapiens
ccccaattcacaatcctctacttcctcatcttcaatgttcctacattacactattgtaaatatcccctatttgatattttggtttctagttttaaactattcaaatccatctttcactctaccactagattattctatttaaaacacaaaacatgtcttattcatgtttgaattcctaataattagactggattgttaagacaaatctctctaagaagatctcttttaagatgaaaccaggctaacaattagagccagccatgtagagattaagaaccaggcagagggatcaaataatgcaaagaagaatacaagagtaagcttagtgcgtgtggcaggcagaattttaagatggctctaagattcctactctctgatttacacaccctgtatattaatcctcccctcacatgtcagctcaatctgtgaataatatgcaacatcactcttgtgattatgttatgttacctggccaaagaagttatgtagatgtaatcaagctgggttagctcaagttaatcaaaagggagagtatcctggctgagccagacctgatcaggtaaggatcaggtctgctcacctgaggtcagaaaaattcatctgctggctttaagaaagttagcagtcatgcactgagacagccatgtggctagaatctgagaccagcctcaagttgaaagcaactctcctccaatagtctacaagacaatagaggcctcagttctacaacctcagaagtgaatttaaccaaaaacacatgagcctggcagagaacaactgaacttcagaggagaccacagtcttaaaagacaacttgattgcagccttgtgagaccatgtacagaggacctgttattagtccattctcacaatgctatcaagaaatacccaagaatcgataatttataaaggaaagaggtttaattgcctcacagttccccattgctagggaggcctcaggaaacttacaatcatggtggaaggcaaaggagaagctggcactttcttcacagggcggcaggacagagtgagtgcaagcagggaaatgccagatgcttaaaaagccatcagatctcatgagaactcactcactatcatgagaacagcataggggaaaccgccgccataatctaattacctccacctggtcccaatcttcactcatggggattatggggattaaaattcaaggtgagatctggatggggacacagaggcaaattatatcattccacccctggcccctcccaaatctcatgtcttttcacacttcaaaaccaatcatgccttcccaacagtaccctaaagtcttaactcatttcagcactaattgaaaagtccacagtccaaagtctcatctgagacaaggcaagtcccttccacctataagcctgtaaaatcgaaagcaagttagttacttcctagatacaatgagggcacacacattgggtaaatatagccattccaaatgggagaaaaaggagctacaggccccatgcaagtctgaaatccaatggggcaatcaaatcttaaagttccaaaataatctccttttgactccacgtctcacatctgggtcacactgatgcaagaggtggtctcccatggccttaggcagctccacccctgtggctctgcagggtacagcccccatactggctgcttccacaggctggtgttgagtgtctgccggttttccaggtgcacagtgcaagctgtaagtggatctatgattccgaggtttggaggatggtgaccctcttcttgcagctccactaggcactgccccagtgggaactctgtgtggaggcttcaaccccacattttccttccctactgacctagcagagggtcttcataagggctctgcccctgtagcaaacttctgcatggacatccaggcatttccctacatcctctgaaatctatgcagagattctcaaacctcaattcttgacttctgtgcacccataggctcaacactatgtggaagacaccaaggcttggggcttgcaccctctgaagcaatggaccaagctgtacctttgccccttttagccatggctggagctgaagcagctgcgatgcaaggcaccatgttccaaggctgcacagagcaggagggccctgagcccaccctacaaaaccatacttcctcccaggcctctggacctgtgatgggagggccttctatgaacgtctctgatatgccctggagacttcctccccattgtgttagtgactgacattcagctcctcactacgtatgcaaatttctgcatcaggcttgaatttctccccagcaaatggtttttcttttctattgcattgtcaggctgcaaatttttcaaacttttatgctctacttcctcttgaacactttgctgcttagaaatttcttccatcagataccctaaatcatctttctcaagttcaaagttccacagatctctagggcaggagcaaaatgctgccagtctctttgctaaagcatagcaagagtgacctttactctagttctcaacaaattcctcatctccatctgagaccacctcagcctggatttcattgtccatatcactatgagcattttgatcaaagccattcaataagtctctaggaagttccaaactttcccacattttccagtcttctgagccctccaaactgttccaacctctgccaaagttccaaagttgcgtccaaattttcaagtatccttgtagcagtgccccactctcagtaccaatttaggacccagttaagctatgcctgaactcctgacacacagaaactgagataacaaatgggtgttttttaaatcatgaagtgtgtagtaatctgttacacagcaatagaaaactcatggaatatgtttaagaggcaagaacaacaaaagccagtacaactggggtatggtgggcattttaagataaaaaatgggataaattgttaggagattaggttggcgagatagatgagagtcaaattctgtgaaaatttgttgttaaaagtgggaagttttttataattttgcttgttaagtatataagaaagtcatcactgagatttaagcatgggaagaacctgattggcaatttttaaagaacattctggatgctgtgagtaaaatggattgtaggaggggaataacagaagaaggaatgagactagttagaaggctgttacaataatccggtgagaattgaagaaggctgggatagtggcaaaagaagttagatgtggtcagatagcggtcatattttttaaagtggagttaacaggaattattaatggatcaggttgagggtaagaaaaagagatgaggcccagcgcagtggctcatgcctgtaatcccagcactttgggaggctgaggtgggaggatcacttgaggtcaggagttcaagaccagcctgggcaacatggtgaaatcctgtctctactaaaaatacaaaaattagctgggcatggtggtgcatgcctgtggtcccagctactctggaggctgaagcaggagaattgcttaaacccaggaggcagaggttgcagcaagctgagatcgcaccactgcactccagcctgggtgacagagcaagattctgtcaaaaaaaaaaaaaaaaggaaaagaaaaagaaatgaatcagggatgactttaagtttttgacttgacgaactaagctgatggtgggttgtcgtttattaagcaggggaagtctatgggaggaaccagttggaatgacgggatggggaaaagcatgtgttctacttcggataagttgttttaactgcctactcatcacctgaatggtgatatcaggttagcagatggttatacatgtctcaaactgcaggcacaattcagaactagaagtaacagagtcattggcatgtaggcagtatgtaaagcaaaagtactggatgtattactttgggcaagtgtgttaattgaaaatacaaggttttctgtgcctaatccctggaaaatacaactgacatatttgaggtacagcagaggaagaggagtttgcaaaggagacttaaaaagagcagtcaaggagggaagaataaggaaaaatagtataaagtcatttaaacaaacagaagaatgtatttcaagaaagagaaaacaatcacactttatcaaataatgctgaaaggaaaaaaataaaatacattaggtcagagaagtgatcattggattcataatcatggatatttaaatggtagacttaacaaaagaactgttggagtactggttgtgatggactgcccattaaagcagagacaggacaaaatctaagtgtaaaaaaaccagaaacaataatgacagtagatatctctttcaaaatatgtcactgtgaaagggttcagagattgaagctattgtgttgtgacagctggggtcaagagattttgttttgtatggttggcggtaagatgggatatatcacagcatgtttttagaaagtacattggtatccagcatactattgcaataaaattaaagctgaccttatctgattctacctaactgaattttaatgctaaataaagccaaaactttagccagttcaggatagtcatcatatacatgatggcaaaatgaatgttaaaaaataaacaactacattgagagaagataccaggcatccagagttattcataagttaaatgactggttcctacacactggtctttcaacaaatattttttggactttttttttttttttttgagatggaatctcgctctgtcacccaggctggagtgcagtggcgcgatctcagctcactgcaagctctgcctcccgggttcacgccattctcctgcctcagcctcccgagtagctaggactacagatgcgtgccaacatgcctggctagtttttgtatttttagtagagacatggtttcactattttggccaggctggtctcgaacttctgacctcatgatctgcccacctcagcctcccaaagtgctgggattacaggcgtgagccaccatgcccagcccttttttggacatttttattcaaagttgtgagtaccaataattttctataaaagcattagaattgtcagactatgagatgggcacggtggctcacacctgtaatcccagcactttgggaggctgaggtgggcagatcactgtgtgtggtcaggagttcgagaccagcctggccaacatggtgaaaccctgcctctattaaaaatacaaaaattagctaggcacagtggtaggtacctgtaatcccagctactcaggagtctgaggcagaagaatcgcttgaacccgggaggtggaggttgcagtaagctgagatcatgccactacactccagcctgggtgacagagtgagacttcatctaaaaaaaaaaaaaaagaattgtcagactatggatggacttaccctctattttccaaccatctgtaatatttctatatggagtttcaacaaaaagtaatgacattaaacatgatactgtaaaagataaataaaacctcagctgaccaaagcatcataaatgtaatatcttaaaataataagagcataattatattaagacctacagaattatccatgtctagtgaaacataaagtaacaattttaagactaaaattgtaaagagttaatggttttcaacaaacacataccaaaaattaataattaatttttaatccatagaattttagaccataaaaagatcttacatgttattttgctcaacctattcctagtgccaaacttctttcttcagcatctctgggaaatctatgcttcagcttgaaaatgtccactaagaagctcatgctttctcaaggcaagtacagtggaacagctttcatatattaagctaaaacctgcctctcccaaacttccactcattaatcttagttttgtccttggaatgcatacttagaaagctctgaaattaaaggaacagggtctttacaaagcaaactgtttgctttcaaacttttgttactaggaatatctcaaagtgggggggaaatagtgcttctgtgcttaacaaatgagctctgtttataatcaaaaaagtaaggtttacataaattatttattatcaggaaatccctaaattcagaagtagcctatagaagttgacgttttaacaaattactaaaatcagcttttgttttgttatctgatgtggtcaaagtgttatgcatggctagatacaaatatagcaaaacttcaaactcacttcctcttttcttctaatttaatatttactgattaaatcaaattttaatatgcacttgcttctgcagtagaacagatatctcataaagacaaaactcccactgaacgtagtggtagtcatcagtgctcacagtctaatgtgcactgcaaaaacatgtagagaaaaatccattaaactacattggctattgattcttttctcctgagaagttccagccagaattcattgctatcactgtcttatgcatggtggtgcctcactaatgaaagattcagatttttttaaagggtctacctggcctaaataagatatgccacttaaaattagattcataataaaccaaacaccgcatgttctcacttacaaataggagctgaacaatgagaatacacggacacagggaggggaacaacactcactggggcctgtcgggggagggttgggggagacagagcatcatgataaagagctaatgcatgcagggcttaatacccaggtgatgggttgataggtacagcaaaccaccatggcatatgtttacctatgtaacaaacctgcacatcctgcacatgtatcccagaacttaaaataaaataaaacttttttaaaagatggtaacaatagacactggggactactagagcgcggagggtggaaggggagcaagcatttaaaaactacctactgggcactatgctcactacctgggtggagggatcacttgtaccccaaaactcagcaaagcacaacatacccatgtaacaaacctgcacatgtaccccttgaatctaaaataaaagttgaaataaaaaataaattaaaaagagaaattttttttaagtagattcataaatttcacaatttataaattaatacatatatggttcgttgttcatctcatgataaaatcacttggaaaaactccaaatgtcattaggaagatacctataagatgatgtagagtcattttatggagtctacgatatattgttaagtgaaaaacaaaagcttcatatcattcctactcgatttcaaggtgtactataaagctacaataatcaagacagtgtggtattggtgaaagaatagacaaacatattagtggaacagaataaaatccaaaaataaacacataccaatacgctcaagagatctttgacaaagtagcaaagcaagtcaatgtagatagcgtttcaacaaatggtgctggaacaactgaacatccacatgtaaaaaaaaaaattagacacaggtcttacacttttcacaaattaattcaaaatggatcataagcctaaatgtaaaatgaaaagctataaaacttctagaagataacaggaaaaaaatctagatagtgttgggtttggcaataacattttaggtgcaacactgaaaacatgatatataaaataaaaattgataaattagacttcatttaaacttaaattgaaaaattctgctctgtgaaagatactcttaagagaatgaaaggacaagccacagacttggagaagatcttggcaaaacacatatctgataaaggactggtattcaaaatatacaaagaacacttaaaatacaacataagaaaacaaataacccaatttttaaaatgggcaaaagatcttaacagctacttcaccaaagaagatatacagatgccaaataattgcatgaaaagatgcgaataccatatgtcactagagaactgcaaactaaaacaacaatgacataccactacgcatctaccagaatgactaacatataaaacactgacaacaccaaatgctggtgaggatgtggagcaacaggaactctcattcattactgtggaagtgcaaaatggtacagccactttagaaaacagtttggaagtttcttacaagctaagcacaatcctaccatgtggtctagtcatcacactggatttatttcatttgagaatttatccaaatgaaaataaacccacagaaaaatctgcacaggaatgtttatagcagctttattcataattacccaaacttggaagcaactaaaatgtctttcagtcagtggaacagataaacaaactgtggtatatccatgcaatgaaaaattattcagtggtgaaatgaaataagctttcaaagcatgaaaagacataaagaaaccttaaatttatattactaagtaaaataatccagtctgaaaaggctacttactgtataatttcaactatatgacattctgaaaaggcaaaactatggagacaatgaaaagatcagtggttgccaaagttctgggggataaagcaagggatgaataaggagaccacaaaaggtttttagggtagtgaaactattctatatgttactgtaactgtggctacatgacattatggatttgtcaagagccacagaactgcacaacacaaagagtaaaaccctatataaacaatgaactttagttaataataatgtatcaatatcagttgaacaattttaacaaatataccacattaatgtaagatgttaataacaggagaaatgggagaggtagcaggtatatgggaactctgtactttctgctaaacttttctgtaaacctaaatttactctaaaaagtaaagtctattaatttttttaaatctataagcaaaaatgtatgcatacatagcatgcttttgattaagaaaaacggggcagaaaacataggaaggataaaccagaaaaacgttagattacctatatggggtgggtagaaagagcagaaggtataggaaagaggtaggatttctctgagtatacctgtttatatagttttgatgacatattaatattttatataataaaaacaaaactaaatcaacaagaatgttgtggaaagtccttataatttgctaaaaacaaaaacatataaacctaattatatatcaaatagataactatatagaataaaataaaaacaaattaatccaagaacgttttgaatacaatactgtttccaccctcagtggaaatattctaaggaccaaaataaccgcaaataaaccttgaatttcacttggtaaatttggtggcattgctggtattgtacagcaatttaagtgtgtgtgtgtccgtgtgtgcatgtgtgttgcacaagcacatgtacatgtgttaaaaatgagtaaataggcggttacactgacactattgggaactgggattttcaccatgaaagaaaggaaatacaaatatggattgaggaacagacagaatttgtggctgaagagaataaatccatgacttaagaaaaaaaaatgctttctaccattacctactaaaaggttcccgaagcaataacactctacagcaaacaataagttcctttgctatatatttaagcctcgggtttatgaatctaacattgcgtcttatctgtagttgggacatgctgtttcattcttggaaaatttctttttcctcttttttacctgcttaatgcttactcattcttaatgtttcagctaaatatgactatttctggaatataataaattaccatcgatttctctccttaaggcctatgatgacttcacactacttaatagatatccagatatacacactctgcccatggttttctttatcagattgtgctggactatcttatctagcttgttttcttcctactgctgttctgtgtgtgtgtgtgggtgtgcacgcacgtgcgcaagcacatgtgcgtgctctttattagctctaacagattttcttatttttcaaatttattcattcacttattttttcattcattcagattcattcaatgacacaggcagtgtgccagtgagtctcccaagttccattctatacttgggaacatttcattgcccccctgccacccacttcacacagacacatacgtgtgtgtgcatgtgtgcacatgtgcacacacactgctgaaattctacttctgtaaattcttcaattaatggaagagaagtcaccatttttccatgtgttttttctttctaaaattgtgccatccatgaatctaccattcaaataacagtgattcttttcataaataattacttacttaatttatgttttgctcagctctatctcttcagtgctgactttcttaagctataaaatcctggagagtaaaaatatatgccttttcatcccctttgcccttagtccagcacctgagaagccgttaagaaataccaacaataataatgcattatgcacagtggttgcacaataaatattgacagaatgaaaacaatacccttaataaatgtgaaagaacagagtcttcttgtatt

SEQ ID NO: 1158 - DNA, 456067 bp, Homo sapiens
gcaagtaaaaagtctgctcgagtctaaagtaatacatcacatggtttgagaaccagaatgtataggtaacctggcccccaattatgtctgtattgtttccataacactcatgattctgacaagcactgtgctttgaatataaaagatatttgatacatgtttgctggatccaattaagggctataaatgtgaaatataatttattccaatcaaacaaatctggggatataaaattttacatagtactgtactaattgtacagatcccaaaggcccctgtatatattgtaaggaagcagtttaccagtagaccctcacagcgcttacgacttaatgatttttaatggcctccaaaagtgcttcagacctgaaaaaaatggtttcaaaatatgaaaaacatttcacaggttagatgttctagctttgcgaatttcaaggttacattactgagaaatcacatctaaccataaatcacttttcagcaaataatttcaaatgaaaaaatttaaaaataaaacaatttttgtttttcatgtggtacgtagcccagtatcatatgatactggagaccccctaagaagctttaaaatgaccatattgcaaactcttaacagagaccaactttatctttatattcaaggactgtcagcatgcttaccacattgtagtcccttgataatcatagaagggatcattgttaaaagcactgcacattttgtattttttctctaaatcttaatctgactcaatctctttttaaattgtatattcctttggtaaatatttcaatctgcttctgattacaaatcctgatgcttattactatcagatcctgttcctaggtcacagttttcttaaaattctaaaacaatacatatcctgttacctcatctcttgtaatcaaagtttaagagataatttagataatagatactgataataacagaaaaagatttaaaaattaccatttgtgaatggttgagaatggttgaatcctaggtaataaactaaaaaaccagatgaattaaaaaatgttgcaaattgtgtatgtgtgtatgtgtatatactatatatatgtacaaatatactatatatacacaaaaatatgctatacatattatatttttaattgcaaaacttcaaaaattctttaatatattttgcaatgaaaatgtatatatataaacatgttatatatacataaaacatgtttacatgtgtatatatatatatacacacacatatacacacacaaatataaatgctaaaggatagcccttaaacaataatattcacagacacacacacacacacattcttaagaatttatagtgagaggctgggtgcagtggctcacgcctgtaataccagcactttgggaagccgaggcgggcagatcacttgaggccaggagtttgagatgagattggccaatattgtgaaatgccgtctctactaaaaacacaaaaattagccaagcatagtggcgcacccctgtaatcccagctactcaggaagctgaggcaggagaatcgcttgaaccagggaggcagaggttgcagtgatccaagatcgtaccactgcactccagcctgggaaacagagcgagactccatctgaaaaaaaaagaaaaatttatagtgagagaaacattagtaaaatagtcttattgctggtttgttagattaaattcagttaaaaaaaaacacccaaaacctgtatctcaagtacatttatagatttaatgcagtaaaaattaaaatcccaatagagatactttttaaactcaacatagtacttacaaaatacagattttataaagcaagcaatcaagtcagctgctagttttaatttaataatggataataccaacactgagtcatgtggtttaaaaaataggaaggcagaaataaacaagccttcagaagtaaaaccaaaacaaaaggataaaaacgagaggaatatgagttattgttcaatggaaagtcataggaaaactagatatcaacaagcaaaaaataatatagagccataattgaaatttatgttaaaaggagttctaaataagatgaattaaatgaaaaataggattgagaagcttaatcaactggatagtttttttaaattacatgatgcacttgtacacatacaaattaagacaaaaagaaaagctgcagactgggaaagattttgtggtaaatgtaactagaacatctgaggaattaataaacttattgaacaataccagtcttcaccaaggaaatggccaaaggtaaagcaaacctaatattaaaaattgtagaccaaaagcaaggtactaccaagcctaaaaaataataaaatcaaatttagaaaaaagcaaatgttagtaaggtggtagaaaatcagatacaatcatattactgacagctttttgatttgcagtcatctggctaatatagtaaataccctgattattttatttcagtaattatttttaagatataaggcaaagtaatgattaggaaatgtatttttacaaatgcagttttatgaggggaaaataggttaaaacatttaattattgataaactgctaagcagttaagggtaagctaataaaatacaacttatgcttgttaattttctttccctttacccatgtagatatgaggtaaaaaactatatgtaaaaactttaagtgaagacatgacaccctagaatatacacatttgttcactgagattcattcaactattacttcattccaattatttttttttgttttacatccatcagattttgcttgataaagaagacatttttttctcttcctttctttctttctttttttttttttttttttgagacagagtctcactctatcataacccaggctggaatgcagtggtatgatcacagctcaatgcagcctcaacctcccatctcagcctcctgagtagctagggctatgggtgtgtactaccacacctggcttatttttgtattttttgtagagacaaggtctcactatgttgcccaggctggtcttgaacttctgggctcaagcaatccaccctcctcggcctcccacagtgctgagattacaggtgtgagataccacatcgaacccattcttctgatttgccaggaactacgcgttagactgcagatgctgagcatcaaaaggttgaatctctacctttatggagctcacagtttagtatgtatttacaacaattctgtaaaggttacagtaaactgtcttaaagtcctatgaagagattttttaagtactatatactgatttgaatatcctacttagctttctacaacaaattaatattgaaatttgaggggctatgatcaaattatgatacagacatgtggaagacgtgatggtttcttagacataattgtttcgtatttgtcgtgacagaagggaaaatatctttgagatgtaacacttttctggataagtactgtgatttatcttctgtcctggactgctttttccacccacgttctatgtaattaacctcttaacattataccctttcatattaagttctttgcttattgtgcagagatattttcaccatggcttcaaatttcctatctctggaatattttagtcatttctgaaactcctctaagagtgtatggttcacaacccacaacaggaacctgaaggtgatactacagatttaaagtagtcttaatgatagtgaaatgacttgaaactaatagtcaatattttagtgttctggtttcatttttggattttattccaaaacctccagaagtacacattcccattattctacaatgctccattgtgatgtgaaaaatataatcactggctatgcttttaaacagccataatatgtttccttatatctgtagacaacttttactttttaaaaatagcattctttaaactgatatatttctggattcaaaatattaaaacctcataaacaagataacttttctgcattataaccaaactaaataatactaattttttacataaattatgtcttcgcatatgtacacatatgcacaccaagttatatgcacattttacttgacactttgagaaaaaccacaagatccaaaatcacaaagtgaacaagatcctaatttgattttcgaaggggagggagattttatcttaaaaacataggcaaccatttttgttttattgtaccttaataaaagcaaacttttacctgggcaagcatggggaagccaaggttcctacatccattacacggagttaatgcttcccaaagtcctgatggcccacacgtattttcatcatcatcctcttcttccacttctcctggtgacaaattgattgtagatgaggttctctgaaattaaatttatatcataccaatatattatatcaatgatatttagatatcttaacatcaattaaattctataaatgacagtggtatatctcggcaaacaagtcagctcacttttagccacagttacatggctgtgccctgtgcctgagataaaaatatgtatagtccaacttaagttaaaagtgaaaaaaactaggtgtgaaagacttataaaataatatatgaagttcataatgaagaatagaacatgataatggcctaataaaatatttgaatagcaacaaatgagaaaaatcttatggtttatcaagaatttaggtttaggcataaaattaaggaaaaatgcagttagggcactaacaggaaaatattttattgaaatgggaactcctgataaaccagtttgttcagaatgccactgaaataaaactttataaactttcatatcatacatataacaggagtaacagttttaaaattcataatgagacttccatatttagcacatatattttccttcgttatctcccaaatctcactaaaatgatggtagaacatttataaaaatgtttacaccataaaaataaggatgacaggagagatgaacagacaatattaagaaaacttctggataatgttgagtaacttttggataacagatgggtattacctgacttagcaaacatgagaacactgaaagcaaagaaccttcatgtggaaagaattggagggactggctacctgtgaaggtgtaagtgtaggtggggcagaaacagactgaaactcagtatcagaaagaattatacccctagacccatctccttttcacccagccaggaaactaaatctttaccactggcaagaaattagaggtttaatttttgaagaagttgaagcaaaaggattatgaattctaagactacagatatactgagtctccaaaaacaagagaattaatatctatatagtaatgaagattcataacctaccccgtgccttaccatatttgcattagacaacatggcagcacggtttatattcccagataaacaactagaatactcctccctgtagaaacagacctcctaagaaaaaaggtctataaataagcaggaaaatggtgggatctatgtatcaatctctactgtgaagccaacctctcaacaagttccactcacaagaatcatatatttgagaaaaacctcttaacagacaccaaaataaatatagagaaaaaagttataaatagtatcctcagagagaagatatttatagccatgaaacaagaacagaaagttacaaaatacataaaatccaatacaagagtaagaaaaatctgagaaaatttcccaaaagatgaacagaatttaaaagtggagaaaactaggggtcaaaccaagacctctaacatctgaacaaaaggagctccaaaaattaagagtagagatgggagggtcaaagaaataaagcatgaaaatttgcagaaactgaggaaaaacttcactctaagagcctgctgaatacttagcagactcaatttaaaaaaaaagatgtatatgcataaataaaaagaaatacactaaattgtctaaaggtcctctgaatgtagcgttcagcacaacattgatagatcatgattactaaagcaagtaaatatattctacatattggattgtaaatagcatcctccccccaaaattgttccttttaaaaatagaatataagattttatttttcctcctatttaaaagaatttgttttctgcattcacattttaacttccccttgatcacttgtcagtaactaagaagcaatgaaattaagttgtcccccaatcagttgctgtctataaaatacaataataataacaactgttagactgagaacttactatgtgacttggagtatcactggcctattgtctgttaactattttaattcacacaacagccatttgaggcaaatatttttcctctcactttataaatgaggaaactaagggacagagaggccaagtaaaacccaaggtcacgaagctggcaagtggcagaaaaaggattctaacccagactagggggctgcaaaacctactctcccctcaccactacattctgtgaccactcctttggtacaataacctgtggaagacaatatactgaaaaaccacactgatgtaaataattgcagtttaaataaaagaggtatatttggtgaatacgtttctgttacacgagtaaagtcctgagagcattttgccttctgtgacagggagtgaaaatttctgcaatttgatacatagcagcccatgctttcataaatacacacttctcaaatcaataatagaaggtgattatcacagggatttttgaccctacagatcctttgagtaaaataaaaaatcttgggaaatttaaaatcttaatctgaaagagtatatatatatatatgataaagttgttcacaggaataaataaaatgatcaaaaaggtatctcctttaccagctcatgatcagctaacagtttgaccatcaacattgatgcggcacatactataaaccacctcatagttggccaagaattatcaacattttagattaatccattcttttctattttgttaatggtgctacaatgatttaatccaatcacacagggaacttcctctatctctttctcctccctcaaaaaaaaaaaaaaaaaaaaaaaaagcttatctctcttccctgctcataaagctccaattacttcccatttcacagcaaatgatatccaaattccttaatctggcttcagagttctatagtcaaatgattttttagcccttttactttttcactatactcacctcagattataaccaggtggaattgtttacccttgcctaatcatgctctatgcttttattctttctttcaccttacttgtctgcacagcgtattgtagtggttaagggcttgggctctaaaattagacagtcctgaattcaagttccaaatacccgcctcactagccgtatgattttcagcagataagaccattgtcagcctctcttgccttatctatgcaatggaaaacaatacagtggaacctctctcagggctttttcctgatgactaaatgaggtaataaatataaagtgcctgacacatacagcttcaataagtattaactatcatgtttattattttcttataatcccactgattcaaaatagagttcagatttcatcccttacctaaaattttccagatttcccacaagcatgcatgatatcatgttcttctgcttgtctctctttgtgcaaatgtttgcatttggtatttcacattcaccttgagttgatagatgctatagtggcaaagagcattggcttttaactcaaacagatatatgtttaaatcctagctctaccacttccaagctttgtgattttgagcaaatcacataatcttattaatccttagtttccctatctgaaaaaatagtgtaatcatttccacttgcagggctgtatgaagatcaaattaattgcttgacagagactggcacataaaaaatcaataagtactgctattttattttttaccataaaagagttgtgtacacacacacagtgtgcttgtgcaaatatactacacagacacaagtgtggcttatttacccttgtgaagtaagttatttgaaagaaaacattgccttattcacattgtatctcctacaatgtgttgtgcataatgaaacaataaatatttattgaatgaatcactgaataaatgagcttcaaattattattttcatttgactacctagaaaattttactaatattaaggggtgtgtataattgtatcacaaatatcaagattgccattttagctttattttatattaactattacaagtagctttgcagaaatgaagaaacttatcagtggtttagcactgccccctaaagacagcatataaattggctgtgtaaaaccataatttttaacttcatttctttacagttaaagatttgaaggaaaatattttatcaagctacatataatcttcaattatatatgggaagaagccagcggaacacacttaacctcagatggtttcatttattccaaatgctgttcaaactttttactggagaacaaactctgttcctgaagttccagaaagatgtgaaaattctactataaaaaaaaatagacctaaatctatacagtttgaacccattagctttcttggttattacacggtaataaagaaagactggaccaattctatgttgttgcaaattgaaaaacagtcacaataatatactgtagggagacaaacttgagctcaatcaaagaaaaacacttttgagaataattatattagtctaacattgaagaaatgggatttccctgtgaggcagtgtgtgttcgtgtgtgtttgtgtgtctgtgtgtgtgcatgtgtgtatgtgtaaattatatgacaactatatataacggtgcttcataatttataaaatgctttcagatagagaatagcccaataaaatagagtaagaattatccctattttacaagtgaaaaaaactgatgctcaaaatgttactcgatttgcaagatcatactacaaatcagtccagattataatccaagccctctaaatctaggtcctattgtctttctaccacaccatggaagccacctccttaattactagaactcttcaaggggacaacaaatgttcaagattgtcaatgcaaagggaccaggccaaaaggcagaatccaggaaagaggcaatatcagagatggcaatcaaagcaaaaggcaacaatctggaatgagttagcaatctagactactttatagcattgccacacgcctttttgcctttgtttagttctaaagtaaaattgctttatagatttttcaatgaaatttaaagtaatacatgcttattgtaaaacaaatcattcataatgaaaaattatacatgaaagagtgaagctttcctagcctcggtcccacattcagtgggtgtacttccagactttgtaatacttactctacttgcctgatgactttctcacgataaattcataaatgagaaattgtatacaccaaagagtatgcctacctttatctttctttttctttttcttttttttttttttttttgaggtggagtctcactctgttgtccaggctgcagtgcagtggcacaatctctgctcactgcagcctccacctcccaggttcaagtgattctcctgcctcagcctcccaagtagctgggattagaggtgcccaccatcacacctaattttttgtatttttttagtagagatggggtttcaccatgttggccaagctggtcttgaactcctgacttcaggtgatccacctgccttggcctcccaatgtgctgagattacaagcatgggccaccgtgcctggcctaaactttctaagtattgccaatgttgtctttaacctgttcacagtgatcagagaaatgttttttcatatgagaatgtgatcatgttttcctcttccttaaaaccttcaatagcttttcatgttcttctgataaagttcaaaattcttaatatgatccaaaaggctatgcatgatctgcccctacctccctctgtatcccaccactaatctggcaggccaggtctcactaacagctgaacaggaaggcctccatgacaactgtttcagcactgactgagtggttaaattaaatatttaaagctgatagagccagtgcccttatacgaaggctggaatgtaacgaaagcccaccaagagttttgcctaggcctttccagggccttgaagcatgatgaaataacaaaggaattcttaacagaacccgtttagtattaaacaggttttactgggggtctgaaggaactccccagacctccacaaacaagttttattgaggtctaaaggaactcccaaatcttcatgatttagcaggagacaagataagcgtaatcacccctggcacctggatccatctagattgagtaaatttactgaagctccagaggaaggtcttcaggactcagaccttaggtatagatgagaagaagttaatcacttatgtctttagatgaatgcacacttacatgtagacatacagcttagaaggtatataagctctggaaaactttgtaattttgagttggtctggcaatattttccctggccttctccctgtacccgtttacagaagtaaattctcttctttcccagttggtctgcatcttgttattggaccatgagaataagcaacccgacccttggtttggtccaggaacactaacactattcctctcctttgcccataatgtttaaacacactgagcttccctctttccctcaagtataccaaacttcctcttgcctcgtaccttaccttagcacatgtggttttctctggcaaagactattagtcatctcccaatatacagtcccccctcctccttttgtctttagtaacaccttcttttattcttgtatggtactaatactccaacttttagctgggcacatgtattctttgaataaataccacattgtccagtgtctgttgcagctaggtgtgaccacatggctaagtcataaccatgggatataagaagtgctcttgaagtgaataggtgtgcccttcttcctccccttcctcttcctgctgattgaatgctaatgaaatagctggagctggagcatttgtcctgggccatgaagtatccttggaactagaggacctgcacaatggaacaacaaaatagaagaatcctgggttcctcatagaggtgatccctaccagccttggactgcctagctctaagctttagaagtgggagtaaaacaaactctttctctttaagccattattattattttagatgtttttgttatttgctattgtgtcaaaccctaacaaataaattcctttgcttgtcttcatcaggattaatcttattggtgctttaggtataaatataattcacttcctttggaaggccttcttgatgctctcatcaagattaatttcctttcttatatgccttcacagtatcctgcttttctaatagcaattatcacaatgataattttatagttactgtgtgactttggttcagtatctcctatccttagtccataaaagctgcatgattgcagagatgcctgttgggttagctaccaaagcctgatacttggctagtacattgaataacagtttatcacatatgtgttgaaaatgaatgaagagtaaatgaatgaatgaatgccagcttgccctcatagatgttttattagtgtgaacattttcactagttctaagaggaaccaatgtaactataacccagattttaatgtcctttgttctctaactccatttgctcccactgtcttccttccatattcaaaataatgtagaaaacagcatctatttgatttcatgaaagaatacatttatgacaaccattggtgcacaatttacattttaccacaaactctatagcggaggtgaatgggctttaaattgcacagcttaactcctccccctcccctatcaatatttttctccttatagtaataattgggtagaagggtgcttttcatctccccttccaccaagaagaatagaattcttggtgtctatttttgcctgcagactgttttcattagctctttaaattcttctcctctttattatgcaagcaatttcacactaggatacatcttatctgcaaatttgcatagccaatctcattacacaagagatcttacatgagaactattattttgtcaatttaaaaggcaacaactatgtaatagcatgatatatcatattttcctttttacaatcttttaaaaccggggatctaagggcttaatggggcactaagaagaaaacgtgaggtgttaagctggtttacttattccaaagctatgatagtattaatgatcagatagatgataggtcagtgatcatattactcacaaaggaacagactcaaccatcttaaatttagtcctgggagagatatcacatgccacagttgaatatattagcaatgatcagaaaacctactgttaaagccacagttgaacatattagctatgatcagaaaccctactgttaaatacgtttctataagcttagtaacactaaacatctgttcaaaattttctgaaaattaccttgcaaggctaccctacactacctttcaccacaaccatttgttccatgttagtaaaattcacaaaagctgcaacatttaagtctgctgaaaaataaaatttctctaagattaatttggagttagctgtgaatcctgtactgcatttatatctgcaaggaaaagaaaggaagaagaaaaacaagtcttgatgccaatgagtacactgagtacatctcctagtatctgcactctgaaatgacgttactatgtatggtgatattttaaacttgaggatttgccagtgccaaatgtatttcacatttattgaaggacagaattgctattaaagcaattgttttagttgcaagaaatattgaacaagaaagtaaggatagtctttctctttttaatagtacatgagacattacaattcctctgaaacgcttagttccaacacattatgttcctgcctgctgtttacatatttgacatcctttgcataacatcaggaaacttcaaagaacatattttgtttgctattctacttatatacaatcaatttgaacgtttttattatctctcaaaacttttgttcatttatctgacccttacctagtaattaatactgtttattatttcaatattagaaagagctaagtctaaactgatgccaattttatgcacaatacgcagaagctaatttcaaaaaaaaatgttaaagtcaccttagaaagtttaaactttttttttttcaacaagacagtacagaaggcaaaatgtataactttgggaaaactaaattatcctccatgacagatcattttatatgaacaaataacatttttctaaaagtttacttctttgttttaaaataaaattcattaaagtcttatttatatacctaacatgaacccattttatatatttattttttgtattggtacaaatctttaatagaatttttatttaaataggggattcttatgttactttaatgcaaaatagaaagaaaacaaatgaaattttatataaaaattaaaaacctaagagtaaaaaggtagatgtatgtagaatcctccacagtcagcgtacagtatggcattttcaaaaagctgagggaaaaggagcaagaaactgagaaggaagcaaaggagaagaaaggggagagtaaagaaagaaagaaaagatgacatgcacccattttaaatgtacatacctgtgcattcaccaccacaatcaagatacagaacatttccatcaccgcaaaaggttaccttgaatccctttcctatcaatatttccctactggtagccccagaaatcttttttctgccacaatatagtagcatatacactttatgtttggcataagttttctgtaaagcttattaacactaaacatctgtttaaaattttctgaaaattaccttgcaaggctaccctgcactatcttttcaccacaaccatttgttccacgttagtaaaattcactcagcctaatgtttttgagattcattcctacttttgcatatcagtagtttattcctttttaatccaaagtaatattccattgtatggctataccaaagttttgtttatacattcatctatttatgggcatttggttgttttcagcttgcggccattacgaataaagtcgccattaacattcacattaaaatctgtgagtgcccataagtttttgtttctcttgggtaaatatcgaaaatgctaggtcacacggtaaatgcatcaaactttttaagaaactgctaaagtgttttccaaagtgtttgtaccattttacattcccattcattgtgtcggagagtttcggtagctccacattcttggcaacacttaattttagttattctaatgggtatgcatgtagagttatcgcaatagtatgtagttatcaaatggtatgtagaattatcacaataatagtacttttaatatacatttctgccagtgctactaatgtgctaaatatcttctcctgtgcttagaggccatttaccttcttctttggtgaagtacctttacacatttttattaggttgttcgacttctttttttttttttagacggagtatcactctgttgcccaggctggatggagtgcagtggcaccatctcggctcactgcaagctctgcctcccaggctcacgccattctcctgcctcagcctcccaagtagctgggactacaggcgcccaccaccacgcccggctaattttttgtatttttagtagagacggggtttcaccgtgttaaccaggatggtctcgatctcctgaccttgtgatccgcccgcctcagcctcccaaagtgctgcgattacaaccttagcgtgagccaagtttctttgacttcttattgctgtgttgtaagagtattctttttaaatattctatattctagacatacctcctttgtactgttggtgaatatataagaaatctttgcctaacacaaagttaagatattttcctatattttcttccataagtttaagatttttgcttttacattttgatctttgttctatattgagttaattttcatgtacagcatgaggtaaaggttgagatttaagaaacctatttttttaatatataagtagaagtagtcagccccattacttgaaaagattatcctttccccattgaagtgccctgcagtttttttgaaaatcaattgaccatacgtgtatgggtttatttctgaattctactttgttctattgacctgtaaatctcttcttatgtgaataccacattgatagacgtttataagcctggaatcagagaaacctccaaatttgttcttctttgaaattattttggctattctatgttctctgcctttgcatataaattttagagtaagctgtcaatagctgaaaaattagcctgcttggattctgcttgggattgtagtccatagtacaatttggggagaacaaatatctaaaccacattgtccttcatttcatgaacatgatggtatatccccgtaggtattaggttttctttaatttccatcaacaatatttttatagtcttcagtgtacaggtcttgcccatatcctgttaaatttgtaggggtaaatttgtaggggtggtatatctttgcacgtattaggttttctttaatttccatcaacaatatttttatagtcttcagtgtacaggtcttgcacatatcttgttaaatatgaaggggtaaacacacgtttcgtgtttctggaaaatctttcaaatggtattattaggttaatttaattttcttttccctctagcactattggggcataattgacaaacaaaactgtacatatttaaggtgtatggcatattattttgctatatgtataattgtgaattaccacaatcaagccaattaacatctccatcacgtcatatagttactatggggtgtgtgtgtgtgtgtgtgtgtgtgtgtgtgtgtgtgtggtgaggacacttagaatcaactctcttagcaaatttcaagtatacaatgtgatgttattaactatagttaccatgctatgcatttgatctccagaatttattcatcttataactgaaaatttgtaaccaaacttcaaatttgtaccaaattttaaaattgaattttcagctgagtgcagtggttcatgcctagaatcccagcactttgggaggtcaaggcagatggatcacttgaggtaaggagttcgagacaagcctggccaacatgatgaaactctgtctctactaaaaatacaaaaaagtttagccaggtgtggtggcacgcacctgtagttccagctactcgggaggctgaggcaggagaatcacttgagcccgggaggcggaggttgcagtgagccgagatcatgccaccacactccagtctgggtgacagagcgagactctgtctcaaaaaaaaagaaaagaaaagaaaagaaaagaaaaccctgaattttcagttactgatagttcctcatgtaaaaaaaaaatttgatttttatgtttatttactttgcatcttgcacacattttaggtctagttgctttcctatagatattttaggattttctatgtaaatgatcatatcacctgtgaataaagagttttacttttctctttaaaatctttatgcctttattttctagcccttgtcttactgcactggccagaattgccagtacaatgttgaatacaaatcttaagtgaaaagcattcagcctttcaacattatgaagtataatgttagttagctgtggcatttttgtaaaggctttttattataaggttgagcaaattattcctattctcagtttactaaaagtttgtatcatgaatagatgcttttctacaatgactgatatgatcataaggttttcttcctttattctgttaatgtggtaaaatatattaattgattttatctgttaaaataaccttgcctttctggcatatatcccacttggttgtaatgcaaaatttttaagtgtatgccggacttgatttgttactattttattgaggattttgttactgtgtttatgagtgatattgatctatagttttccatttgtgaaatgtctttgttatcacagtaatgctgacttcatataataaattgggaacaacccttatcttttattttctaaaaggatttcaccagtaaaccacctctatgtaaagtttccttgtggggaagaatttcattatgatttaagcttccttaacataggattatttagattttatatttcttcttgagttacttttcctaatttaggtctttcaaataattcttccatttcatctaggttgtcagttattgctacaaagttattcatattgttcctttattattctattcattctcctggatctttattcatatcccctcccttttatttctattggctgtttatattctattttactgatattgattttaatcattctcactttgggtttaatttcctcttttatctcattttttttaaatgtggaagcttaggtctttcatttaagacctttctccttttcctatataagaactgaattctatgagactcctaagcactgcactagctttacctacaaagtttaatattcttggttcttatttgcatttagttaaaaatattttctaagtttctttgtgactttagcaactagattatgatgtatctttgtctagttttctttgtttttgtcatgctttgcatttgttgagcttcttgggttggtgttttcattcaagttagaaatttttcagccattgtttttgttatttttttttgttattctttcattcctaacccctcctctccttctgaatctccaattacacatatgtttcattgcatgatattttttcacaggctctgttatttattttagtcatttttttctctgtattttattttggctactttcatttgcaatattttccatttcaccaatcgttccttctgcaatgacagtctgctgtttattgcatctactttatttttcatttcagatactgtctttttcatctctagatgtttcctttgaactcttttatatctacatttctctattcatgtcacctcttcctttaaacctttgagtatatcaagcatatttatagcaaatattttattctctcatatacaaattctatcaaatctgtaattccaggcctatttttattgactaattttttgcatgttcatgactttcattttccttattttcatgtgtagtaatttttttaagagaaggcttctcactctgtcacctaggctggagtgcagtcatacaatcatagctcactgcagccttgacttcttgcactcaaatgatcttcttgcctcagcctcctgagtagctgggactacaggaatgtcccaccacacttggctctgagtgtagttgtatttctttaaaaattactggacatcgttgtggcatagagtaaagttatctggagatcagtttaattcattcaaggcttgcttttactttttttttttaggtgggtctacagtaacctttactctggagctaacttaaccccactgttaagacttacgttccctctggaatgtctagtgaatgtgccatgtattaagcatgatccctctacttgggctggtagttacttgaatgattgttggccttgtgtgagctccagggatttttctgtttatgtatctccagtattgttctttctttggaggtttttctttttctgtcttcatgaagtttcactcttgtgcagattgatattcaactgaagatacaaagataactttaggttgttttctggacctcttttttggtatagtaccctcttttctgttcctctgcctgaaaattctagctgactcagccttccccaactctagtttctgtactttcaactcagaggattacttgaccctgtttctgtttttctacctggcaccatatttaggaattggattcaggcaaaaagctgggtgatggtagggtttgcctcctttgtatcttttctattagggatcacagtcctgtcttttatccaggtctgatcatgaatgtttgacatatttttgtccagtattcagcagttttcagaaggagccactccataccctattacctcatggaagtttgacaaaacctttaaaggtttgacaaaaacactttttaaaagaagacgtgtattattcatatctgtttctccattttagacctttcttcacttcttaccggctaaataatcccatttcctctattttgtacaaatccctcaaacatattaatattctcttcctccacactgttaactgcacatttatcacataaagttagtcttttctttccatcatcatgcttgtcttgccaatttcctaattcataataaatagatggtcctaggaaaacaatctcacctgtaatatgagagttattcaattaattttttgcatcagtgaatacacataccttttacaaccaacctgaacttcctgtgtgcataatttcattgctacttaacttaattaaaaaattattgtttatgcccaatatttcaaataaatttatttaaatttattaaatatttattgattaaaaactactgtctacaaggctgaactctaggatgagggaagaaaaatataagtatgtcataaactctgaactcaaggtgtaaagacacatatctatacataactagacagtaaaactagaccaaaattataagcattacagagatactaaaacaaggtattagaaaacataaagaggaagcaaccagggcaagtagaggagagaattcacagagtgtttgcatttgagcaaaagcacctcatgagataagaattctgacagagaaaaggggagatgggaatgaggcacagagtttgcatgattaaggcagtatgaatgtgcttgctgtgtctggcaaatgagctattaggaaaggcatggtggggagatggtacatgaaaaataaatcagggctctattatgtaaaactgatagtttaaaacaagttcaacattagtcaaggcacaattttctacttcttattctactgagatcaaaaaatagaaagcttctacgtattagatacaaaaggattcagagactgtttctcttctctaaattcccataattcagatgtttggacaactcaatctattgttttgaactattttctggagattgcatgaagtatatcttatctctgtaattgcaagaacaatattttctattatttgtgtatcctgcaagatgactagcacagttcagggcacatcatgtgtatatacgttttgattagacaactcttgctctttcacatgttctattttgtccttagatgactataaaatagaaatgctttcagtgctgatgtttacgtaaatatgtacttgtatgcatgtgtgtgtgtatattggactgaaacagaaattaataggcatgtttgatcaaaaaaatgtgaagaagtctctcaacagccccgcaatcaaaagataaacacccccattattaaatagcaatattttatccttttcaatatacaacatatattccctgtcttttctcatctttatattgtatacatattatttctatcatattttaagccattttctgggaaagcagttgttcagttacatgaaagtaaaatttgggagaaaaagtatataattaaaatgtatattaactaagtcatgataaatcatcaaaacttaggactgaagcattttatattgaaaataaaatgaatataaattagacattaagtctgttagatcagaagtctgttagaactgactaactctagttcacgacactaaatcaaggtagcagaaataaagtagtatgtggtactactccagatattgccaaatttaaaatgcttcttttgtatgctcaatagcattcagtaaattttttttggttgaaaaatttattaattaacgctagccaaagaaaataaaacctgatgttttctcccccaccccaaataatctttaataaacatattaacaatgctgagtgattttaaaactcttttcttttttgagataaaattttttaagtggaaaagaatttttcagatgtaccaagacaagttcaaaaacatggcaatatccttcaacctatgcaacattctcaccatcttgtcagcatttaattaaatctccctgacccaggttcaaatgccagaattggaatacctgaaccacatcctatctagccaaggcattaaacccatgctggataagtcttctgtctgagataatgaagtaggaggtacccaggacaatcaaagacatcagcaacttctgacttaccaggtttactgttaattcattccccatttcttcactttgatcttcctaatggtgaactaatttcatcttcaagaaaaggaatttttctactcttcatctatggatttccatatctgaaaatccctttcaaatacacgtaactctgaccaaacagaactactccaaacatatctgaccctgtgccactaaatctgtcagttacaacatcaccagggaatgccatcctgtcattgcataaagacaaaacctcttcctgtggcagcctgcagctaataactggttgaagaagtgcagctacctcctccaaactgagaacaattctgaaaggtcaccccagcttctgagttcctgtgatgttggtcaagcagaaacagatcattcagtggacagcacctacagaaaccttctccagtaaggtgtgaatcccaaccttagggagaggtgctctcttccatgattgtccttccttggatactctcccccagccatagaatacctttatagtttgttttacatatttatagttactctcctatcatagtttaataatctttggtgttaaactttcttgggaaacttcaacacagaaatataagcaggaaatgataagaaaagaaaaggctaatgttgagccaaagacacaataaaactggttgaaataagaaaagaatacattatgaaatttaaactattttgtctctaaaagccaaactgattttacataaaatcaaattagtgttttggtggccaaattggagacattcaccaaaatccataccctcaaaaaggtcagaaaacatggtgtatcaaagaaatcaagaacactgatctattctaagaccatataatcttaggtgaaaaagcctgagcagagaatacaaacgaaataatcaaaaatataatagaagaaaactttccagaatcaagaaagatgaggtatacaacaaatgcctggaagaactggaaaataatcatatcaagacatactcaggcaaaatcttttaattccaaggaaaaagaataacctatccaagcttccagaatgaacactcagattgcctactgtactagccaggattcttagaggcaaataatagaaactgactctgttaagtaaatcagatactttgtttttacatcccaaacatccagaaaacaaagaaaatttaaaaatcctgaagtccaccatatctatgccaagaagaaaaaatattatgttgaccttatatttttggaacatatgcaatataaacaatagtataagcattatatgacataaaatgtcaacagactactcaaggtacaaggttataactcaagaattttataccaagaaaagttactggttatgtttaaaagcaagacagataatgcagtcctcatgaataattcttgagataatacatttatcctatttgaaaataaattacaacttgccaagagacaaattaaggaatcaaaaaggtgcaacatgtcatataaagtataattcatgaatattgaaataaattaaatacaaagttttaagcataacaatatttattaatataattatagaatatggttattaatatggtcattattttcagtgaaacaattacatatttatagaactcaagatcagctcaaaattataatttagaagggtaaagtatggcaactagttacaagattaatataaaaatcaacagtctttctatttataagcaaagacttctagaatatacaacaggaaaagaacatgagtcaaaaaatttaaaaatcaaaaattaaaacaactaacaataaccttaaataagaaacgttggtgccctagggaaataaaactaattatgaaataaagaaatacatgtcaagagacaaaggaaaattaatttaaatggagaaaaatgtcataataatgtttgagaaagctgaacttttcaaagatggcaaatcttcctcaaataaaagtgtattggggattataataatttatggatgctttatataagttatacataaagtgagggctgaaactttgtcatattttattatatctaagactagaactgtacataacacacatttgtttaacaataaatactttccaataaatggttaaagtaataaattaatcctagctggacctgcaaggaaagatggcaatatgaatttaaaaaccgctataaaataaaagaaagaagagaagagctaaggaaatgtatgacaaagaatataagtactatgaaaagtaaaacactacaggacttgtgcaagaataatagagtaaatagttctagttcagaactgaatatataatctttattataaaaacacatgaaaaagaagcaccaaagtttataaaaaataagtggattactcaataaactatgatgggaaatgagtttatgtgtctgaaaacaaaacatgcgaattgaagtcttctgtgggaaaaaataggcattttcttttaaaggcatttctactataaatagtagtaaatataatagaagaaatgatttatagacttcatttcattaaaaaaattaacccctgtatttgaacattaatactaaaattctaaaacacgtgaaaactttggaaaattatttacaataaatacaacaaaataataatatccttaatatgcaaagactctatataccagtaagaaaaatagcacggtaaatgaaaagcatacaaaagacttgaaaagatcattttaaaagtagtacaattgaccactgatcatacaaaatatgtttaactactttagtatttatagcaattaaaactcaaatagcaaggagataacatgttttatcaatcaaactggcatgttttcaaaccataatgtttggtgaggggctttgcattgggaatgtaaattaacaaaaatattttgaaggataagttggtagtatgtgtaaagaatctttaaaaagtttcttctctttcagaaattccacttctagttatctatactaagagaataaatgttatatgtatgtgtaatgatattcattattccattgatataaaagcaaataattgaaaacacttaatatttaactgaaaaacactgttaaataaattagagtatatctatgtaagaaaatatttaaagatctttaaaatcatattctcagaaaatatttagtaatatgaaaaattgtcattttattattttaatatgttgcactgttttaaaaagtagtataataaaccctaggaggataaattccagttttaaatgttttttaataaaatttatctttaaatagtgaaataatggcctatttaaattttttaatacttttctgaattttgcaaactttcaatgatcaattcagaatgcttttataatcaaatattactgatgttatatgtgtcaatgaagttatttcacctctaccaatctaacccaaaaaaaggtagatgtgcacaaagattttttactcaaggatatttatcatcatattatatataataaaataaatgtataaacaatctaaatgtttaaccatagaaaataattaaattgtgctacctctgtgtgtatacttttatatattaggatattattactataagtaaaatttcataaaatgttattggcatgggaaaattttcatgaaaattaagaaataaaatgcacagcatgattctgtttcatttttatagtgacttgtgatagggtttggctttgtccccactcaaatctcatcttgaattgtactacctgtaatccccacatgtctttggagggacccagtgggaggtaattgactcatgggggcagataccctcatgcagttttttgtgatagtgagtgagttctgatggtttcataaggggtttttccccctttgcttggcacttctccttcctgctgccatgtgaagaaggacatgtttgcttccccttctgccattgttttaagtttcctgaggcttccccagccctgtggaactgtgagtcaattaaacctcttttcatcataaactacccagtcttgggtatgtcttgatagcattgtgagcatagactaatacactcgcatatataaaaactaagataaaatatattaaaacacatctctgtatgacaggtgaattttcattattcatacatatcctattttccaaattgtctataataagaaaaaacaagctttttaaagaaaaatggaagattattcctccatttagaatcccataatactaagtgatttgttgaaatgttcatcagaatgcagaggcaatcctaagaatttaactgcaaattacagaattttcctatcttcacactttctaattgccaaataatttataaaaataagtaggacttaatttcatgacatgtattaaaataaataaagtaaatggttttcaatttgaaatattccattaagtcttttctaacttgagcttatgaaatgcatgcttgcttcttgtttctttttaggcctttgcttccagaaatgttaaaataacatgattactaaatatatctccaagtttcatacagctactgtgaagtcaaaatctggaaaacaagtagaaaagtggagtacttactgttggcaagaactaccacagatccctaagactattgttctataaatgttaaattataaagtgatacaaataaattagattttaaaagggaggaatggagtaggaagaaggagaatgtgttgtgagacacagtagaacacacaggaagagttgaggtatatatctttattcttactgacatatatcccaaataaatgaaagcaaactcaatatttcatgtattcagattaataacacctatttctaattttaatgtaataggttctttaacaaaaagttttcaaaatatttcaaagggcttataaaagtgaatctttagctttcttctaagtacacttttgcgctcctacatctttcatagcctagacctaatttctagtttctggcctcatctccgtttctaggtcctgctccacagaggtgtgatcaggagggccatgcaccattacaaaattgacatgacttagatcttaaaagcagtaccacttgcccctcctccaaactgtttgtttttttatttttttgttttttttccttaaggctgctcaagaaagtagcaaataatatagcctaaataatatatgatttgttgaggacttttttggaggagaggaaagggatgtgattatttaaaactgcacaagtgggaaacaatttccaaatgcttttcagaaaatatcttgtaattagattctcttttaaaactactaggactttgaagtaaaataatgtctgctgctgagaacactgttgaattgcagttaactcctactagtgatcaaaatgacccagtcaaatctccagctgcttatgtaattctgaataaattctccattttttaagaaggatacaccaaagaaataaagttcagtttgtagtggctcacgcctgtaatcccagcactttgggaggctgaggctggcagatcacgaggtcaggagatcgagaccagcctggctaacaccatgaaaccctgtctctactaaaaatacaaaaaattagccgggcgtggtggcacgcgcctgtagtcccagctactcgggaggctgaggctggagaatctcttgaatgtgggaggtggcggttgcagtgagctgagactgcaccactgcattccagcatggacaacagagcaagactccgtctcaaaaaaaaattttttttcagttaaaagatacccactaaaacaactctgtcttggcaaaaattgcaacacttcaataagggagaatatttggcatgctccattcattactctgttgtggtgtaccttacgagagacaaccaaataagatagaacaaaatctatgttgagaacttactgttctacttaacacaggagtggagtacatactgttaccaagaactgccacagagccctaagactatagttctataaatgttaaattacaaaatgatacaaatcgttttcatgattccaggaagatggcagcctgtgtctgtattctctattccttctccttcctaagtccctggtgtggctacttttcctagaaaataactaagtgtactcttggaggctagaaagaacctggaatcatctgagattttaagtcctaaaaatgaagatataattctggcctaaaacttactggacagtggtcagaaccccttctaggctaacttctcctacataacttggaacaaatgtcacagattcccggataaccacaagcaaggagagaaaattctcctacctgtttactaagagagcccaagtgtccctttacactgtagtgttgggctaagtacaatccatccctgggctaagtacaatccatccctgattgcaccaaacttaaaaaaaaatctctttttctaagcctaaatttcactaaaagcactctggagctaaacactcccatttaattatttattgttgtttaattaccattttcttagagactccaaaacctgagcagtacaggtgttgacagatcccatgtccaataatatgaatgcccattaatatgaacaataaggatcaacaaaccattttatgagacagtggcttaaaagaagaaaacttagatgatcaacaagagtagtagaggtaaaaataacagaggacacacaaaaaaatggggaaaaatgtactataatctcttataaatatgaaattagaatgtgtaaaaacagtgtctagaactaaaagaaagaactcttgaattttaaagttcagttgagaaaatgaaaacgtcactgaagaaaagtaattttgtgttttagaaaatcaagtgaagaaaacagaataaaaatgaaccctgataggtatcaagtacagattaaacatttgtaagttggtgaataatgggataaaaacaaatgaagatgtgatcaaagaaataataaacaaaagctctcctcatctgaagttacactcagattaaaagagctcacttgttaaataatttaaatggcacgtatttaaagataatctgatgatttttgaactctaaagttttgttgttgttttgtttgagacagggtctggctaggtcacccaggctggagtgcagtggcaccatctcgactcactgcaacctccacccccaggctcaagccatcctcccacctcagcctcccaagtacctcggactacaggtatgtaccaacacacccagataatttttttttattttttgtagaaatagggtttcactatgttgcccaggctggtctcaaactcctgacttcaagtgatccgccctcctcggcctcccaaagtgctgggataacaggtgtgggctaccatgactgtccgaactctaacattgaactggaaatattaccagtttcaacaagggaagagaaaagcagatattttcaaataaaaaagaaccaaattattatcaaattcttaactgtaacatcagaagttagaacacaatagaccaaccattgtagattatggaagaaaataactgttaaaaataggcagctggacttgaaatcctgcctaaatatgggaaatggcagacaggagtcaggactaacttgcagcacccactcggatggagagaacagcatgtggagactcacattgtaaacttttgctccaagaactgccataggaacataccagaaaaactgaaagaattcacagatcctttgaaagaagcaccttgttactgcaaactctgtgagacagttgaaaaaatgtcttgaaaagtgtgaaaggggaaaatctgcctccaaacacacatcctccttggggaacctgaaaatccagaccacgggagaaggatttaaacttatctagagctgaaacaaatttagacagccaagcaaaatacaaaagtagaagaagcaggccaggtatggtggcccatgcctgtaatcccagcactttgggagacgaaggtgggtggatcactcgaggccaaaagttcaagaccagcctggccaacatggcaaaaccccgcctctactaaaaatacaaaacctagccagccatggtggcacatgcctataatcccagctggctgggaggctgaggtgcgaggatcacctgagcccaggaggcagaggttgcagtgagccacgatcacgccactgcacaccaggctgtctgttaagactctgtcaaaaaaaaaaaggaagaagaagcagcagcaggaagagccctgtaggcagtctcaggggagccatttctgactttatctcacaggggtctgtgggagggctgcaagtggaactggggaaggaccacagggagaaagaaacttccagctgaacttctgtaataattttgaccaagcatgaattttcctgggcagaatcgggggagggggagaataggaagtgtggacataaacacagaaactgcggcaggcagggaggggtgaagcctgaaatccctgcttgctttctcagctcttagtgggtaggcttgtagcctggtacaagatctcagtactgctcacaggctccctgtatataaactcagtgctattggaggggcgtggtaagagttagactagccttactggctgcatgggagctgagtgaggcccgtcactgccagcttttccccacttccctggtgacctgtataatgtacgagaggcagccataatccccctaagaacataactccattggcctgagaaccacaatcccatcccccacagaagccatagcaagtcctgcccaaggagagtctgagctcagacacacctaacccggcctccacttgatgatttttctccacctgccctggtagccaaagacaaaagacataatctcttgggagctccatggccccactcatcacctgagaatcctgagtacttatccaggcaaccttaaagcaagcttgtatacccctatactatgcagttgatctctcctgaaagtgccacctcctggctagaggccaaccaactcaagccattacagcaactcataaaagaacaaacccactccaaagaagaagaaaacaacagctaattccactgcctgtagcatcctagctaaccagaggtcctgagtctgtccatgtgacaacttcactgctaacacaactagcattgagaaaaccagaacaataaacaaaattacaaccaaggacactcacggagtccacttcacccctctgctacctccactggagtagctgctggtatccacagctgagagaactgaaaatggatcacatcacaggactctttgcagacactccccagtaccagcccagagccaagtagctccactgggtggctagacccagaagagaaataacaatcacagcagtcaggctgtcaggaagccccattcctagaggaaggggaagaacaccacatcaagagagcaccctgtgggacaaaagaatctgaatagcagctctttagccccagatcattcctctgacatattctacccaaatgagaagaaaccaaaaagacaactctgctaatatgacaaaacaaggaccattaacacccccaaagatcacattagctcatcagcaatggatccaaatcaagaagaaatctctcaattgccaggaaaataattcagaaggtcacctaacacataaggactcacataaacttaaggaaaaggggtggaaagagatattccatgcaaacagacaccaaaagcgagcaggagtagctattcttacataaggtaaaacagactttgaagcaacaaaagttttaaaaaacaaagagggacattatgtaatgataaaaggactagtccaacaggaaaatatcacaatccaaaatatatatgcagaagttcccaaatttataaagcaattactactagacctaagaaatgagacagacagcaacacaatattagtggaggacttcaatactccactgacagcactagacaggtcatcaagttagaaagtcaacaaagaaacaatgaacttaaactatatcctataataaatggacttaacagatatttgcagaacattttctatccaacaactgcagaatatacattctatccatcatcacatggaacattttccaagatagaccatatatgataggccacaaaacaaagctcaataaatttaacaaaactgaaattatatcaagtgctctctcataccacagtgcaataaaattggaacaaaaggaaccttcaaaaccatggaaatacatggaaatgaaataatctactcctgaataatcattgggtcaacaatgaaatcaaaatggaaatttaaaaattcttcgaactgaacaataatagtgacacatcctatcaaacctctgggatacagcaaaagtggtgctaaaaggaaagttcatagcattaaatgcctacatcaaagagtctgaaagagcacatatagacaatctaaggtcacacttcaaggaactagagaaagaagaacaagccaaacccaaacccagcagaagaaaagaaataaccaagatcagagtagaactaattgatattgaaacaacaacaacaaaaatacaaaagataaatgacatgaaaagctggttcttggaaaagataaacaaatcaatagatcattagtgagtgtattagtcccttttcatgctgctgataaagacatacccgagaatgggtaatttattaaaaaataaaaaaaaaggtttaattgactcacagtttcatctgactggggaggcctaacaatcatggcagaaggtgacatacacgtcatacatggcagcagacatgagagaaagagaatcaagtgaaaggggtttccccttatgtaaccaccaggtctcgtgagacttatacactaccatgagaacagtatgagagaaactgcccccattattcaattatcacctactgggtccctcccacaacatgtggaaattatggaagctacaattcaagatgagatttgggtggggacacagccaaatcatatcagcgagattaaccaagaaaagagagaatatccaaataagctcaattagaaatgaaatgggagatattacaatagatatcacagaaatagaaaagatcattcaagactacttgaacacctatatgctcacaaagtagaaaaacctagaggagatagataaattcctggaaatatacaaccatcctagattaaaccaggaagcaatagaaactctgagcagatcaataacaagcagtgagattaaaatgataataacaaatcgcaaacaaaagatgttccaggaccagaggaattcaccgctgaattctatcagacattcaaggaaaaactggtaccaatcctattaacattattccaaaagataaacagggaatcctccctaaatcattctatgaagccagtatcaccctaataccaaaaccagaaaagggtatttgaaacaaaagaaaacaaaaaaccaatatcccttatgaacatagatgcaaaaatcctcaacaaaatactagttaactgaatccaaaagcacatcaaaaaggtaatccaccatgatcaagtgggtttcataccagggatgcagggatggttcaacatacacaaataaatgtgatacatcatataaacagaattaaaaacatcatctcaatagacacagaaaaagcatttgacaaaatccagtatccctttatggttaaaatcctcagtaaaattggcatagaagggacatatcttaaggtaataaaatccatctaagacaaacccacagccaatattatactgaatggggaaaaagtgagagcattccccctgagacctgggataacacaaggatgcccactctcaccaattctattcaacatagtactagaaatcctagccagagcaatcagacaaggcacagaaataaagggtatccaactcagtaaagaagaagtcaaactgtcactggtcaccaatgatatgatcatatacctagaaaagtataaagactgatccaaaaagctcctagaactgaaaaaatgaattcagcaaaggatcaagtgacaaaatcaatatatacaaatcagtagcactgctatacaccaacagtgaccaagctgagaatcaaatcaagaactcaactccttttacaacagctgcaaaaaaaaaaaaaaaaagggaaaaagaaatacttaggaatacatctaaccaaagaggtgaaagatctctacaaggaaaactacaaaacactgctgaaagaaatcatagatgacacaaacaactggaaatacatcacatgctcatgaatgggtagtatcaatattgtaaaaatgacaaatctacaaattcaccaaactagaaaaaacaatcctaaaatttatatggagtcaaaaaagagcctgcatagccagagcaagactactccaaaagaataaatctggaagcatcacattacttaacttcaaactatactataaatctgtagtcaccaaaacagcttggtacaggtattaaaaataggcacacaggccaatggaacagagtagagaacccagaaataaagccaaatacatgccggcttgatcttcaacaaagcaaacaaaaatataatgtggggaaaagatatcctattcaacaaatagtgctgggataattggcaagccacatgtagaagaatgaaactggatcctcatctctcaccttatacaaaaatcaacccaagacgaatcaaagacttaaatctaacacctgaaaccatcaaaattctagaagataatactggaaaaacccttccagaaattggcttaggcaaagaattcatgaacaagaacccaaaagcaactgcaacaaaaacagagataaatagataagactcaaactaaaaagtttctgcacagcaaaagaaataatcagcagagtaaacagacaacccacagagtgggagaaaatcatcacaaactatgcatctaactatataaacaaaggactaatatccagaatctacaaggaactcaaacaaatcagcaggaaaaaacaaacagtcccatcaaaaagtgggctaaggacatgaatagacaattctcaaaagaagatacacaaatcaccaacaaacatatgaaaaatgctcaacatcactaatgatcagggaaatataaaccaaaatcacaatgcaatatcaccttactcccagaagaatggccataattaaaaaattaaaacataatagatgttggcatggatgtggtgacaaagggaacacttttacactgctggtggaaactgctagtacagctactatggaaaacagtgtggaaagtccttaaagaactaaaagtagatctaccgtttgatccagcaatcccacttctgggtatctaccccgtgaaaaagaagtcattatatgaaaaagacatttgcacatgcatgtttatagcagcacaactggcaattgcaaaaatatggaaccagcccaaatgcccatcaatcaacaagtggataaagaaaacgtggggtgtgtttatgtgtgtgtgtgtgtatacatatatatatatacacacacacacatatatacacaatggaatactactcagccataaaaaggaatgaaataatggaattcacagcaacctggatggagttggagaccattaccttgagtgaagtaactcagaaatggaaaccaaacattgtatgttctcacttacaaatgggagctaagctatgaagatacaaaggcataagaatgatacaatggactttggggactccagggtaaggggtggggattgaaagataaaagactatgcattgggtacagtgtacactgtttggatgataggtgcaccaaaatctcacaaatcaccactaaagaacttatccatgtaagcaaacacctatttcccaaaaagctattgaaataatacataaaataatagtaattttaaaaataagcagaagaccattagtcagaggctgtctctgcactatgagttgctacatgatgaaccataacctaatttggtatgtaaacaaaccaaaatgtaacttaggagtataacagccaagtttcagctaatcacaagcagccaggtttcagtcaattataggcagccagcttttcacaacatgcccaaataaggcaaaagccttatcacactatgcccaaataatataaatacctcattgtagccaatcagatggtttctcgactttgcttccatgttgaaccaataaaagctcactgctcatgctgctgggcagagctctctgaacctcttctggttctgagtgctgcctgattcctgaattggtctttgttcaattaagctacattaaatttaaattgtcttaagtttttcttgtaataaaactatgaatcaagaatcctattaccaagcaagatatcactcacatgtaagaaaataagtatgacaattatagacatgtaagggttcatttacattatttaaaaattactctaaaaagcattttaagtaactcaaaccacttcacacatactatgaaaaccttagaacagtatactttcatttcctcctatcatttttgtgctgttgttgccatatattttaagtgtacatgttagaaatcacacaatacattttattatttttactgtacacagaagattttaatctcctttaagaagattaaaaacaatgagacaaatttctcttacatttatgcacctatttatcattgtggaacctttcattttttggtagagcaaactttccatctgatatcatttttgccttttgcctggataacttcctttaatctttctatgagaaagatgtgtttacagtgaattctgtctgtgtttgtctgaaaagcttttaccctaccttcacttatgaaatataatttaaatgcaaataaaattataacttgatagttttttcttttagtgttttaaagatatcatttcatcacttcagactcacagagtttataagaaaaagtctggttttattcttttatacatagtactctggtaagtaatataccttttttctctggctgcttttaggattcttctttacatcactgattttcaataattttattttaaatatgactcaatgtggctcctttaagtttattttgcatacagtttattcaacttattggatctgtgggcttagagtttccatcaaatgttgaaaattttcaaacattattttctcaactaatttttctactttcttccctccctttcaggatgtcagttacacatagcttagtggctgagttggtcactgctcactgatgctctgttctattttttttcaatccttcttctttctgtacttcattttagtttctattgctagatcctcaagttcactaatcttttctgcttcagtcctatctctgttattaatctcatctagtacacttttcatttcagctatcatattcattatctccagaagttccacttgagtcatttttttcttacacttctctcctcatgctcatgtatccctttatgtgcttgagcattttataacactgttttatatatacataatataacagctattttgtaaacagctttgctgctaaatctattgtctctgtttctactgatttatttatttttctccaggttatggcttctttacacacaaaataattttttactgtttggtgaacattgtgaattttacattgttaggtgccagattttgttatattctttataaccaggacatagttaattaatatgcagatcagtttcattactttgaggcttcctttaaactttgttaggataattccagaacaatcttttttcaaggccacattatccccattattaaggagagactcttctgagtactcttccagtgccttgtatcttacaatttaggtctcttcttttcactgttgggaatataaaacattccccactctgtgggagctctgagaaccgctgagtattgcttttcagtgggtccttccccagcctcactgtgtgcagttcccacctctccaataccctgagctacaaatcctagcaaattcaagctacctgaaatctaaactctgtctcctcatcaagaactctctccctgctttgtagtctataaaccaccttcaaacacataggtgggtaattgtaaggctcacctcatttgtttctcttatctcagaatttacagacatgtatcgcctaatggccaacaactgaaaacatctgttttatatactgtgtccatttttctagttctttacagtggaaaggatattcccaaaataacaaatgcctcttgatgagagactgatcgttttcggaaaatatcaatataaagaaaaaaggcaccaaggactgtgtctcaagcctgtaatcctagcactttaagaggctgaagtgggaagatcacttgaggccaggagttcgagaccagcctgggcaacataacaagacttggtctctagaaaaaaacatagccaagtatagtggtgcacacctgtagtccaaactacttagaactacttagaaggctgaggtggaaggattgcttgagcccaggagtccaaggctgcagtgagctatgattgcaccatcacaatccagcctgggtgacagactgagatactgtctctaaaataataataataattacatgagcaagtgctaaatttaaaaaaaaaaaaagagagaaaatgcaagttacaaaagttgtgaatttcttacaagtaatatattttaagggttccattgtgtataaaaaaattacctatgtgatcttggactagttatttagactttttagccctaaaatcatctcaattcaaattttcctcaaactgaagaaattttcttcccccaattcacaatcctctacttcctcatcttcaatgttcctacattacactattgtaaatatcccctatttgatattttggtttctagttttaaactattcaaatccatctttcactctaccactagattattctatttaaaacacaaaacatgtcttattcatgtttgaattcctaataattagactggattgttaagacaaatctctctaagaagatctcttttaagatgaaaccaggctaacaattagagccagccatgtagagattaagaaccaggcagagggatcaaataatgcaaagaagaatacaagagtaagcttagtgcgtgtggcaggcagaattttaagatggctctaagattcctactctctgatttacacaccctgtatattaatcctcccctcacatgtcagctcaatctgtgaataatatgcaacatcactcttgtgattatgttatgttacctggccaaagaagttatgtagatgtaatcaagctgggttagctcaagttaatcaaaagggagagtatcctggctgagccagacctgatcaggtaaggatcaggtctgctcacctgaggtcagaaaaattcatctgctggctttaagaaagttagcagtcatgcactgagacagccatgtggctagaatctgagaccagcctcaagttgaaagcaactctcctccaatagtctacaagacaatagaggcctcagttctacaacctcagaagtgaatttaaccaaaaacacatgagcctggcagagaacaactgaacttcagaggagaccacagtcttaaaagacaacttgattgcagccttgtgagaccatgtacagaggacctgttattagtccattctcacaatgctatcaagaaatacccaagaatcgataatttataaaggaaagaggtttaattgcctcacagttccccattgctagggaggcctcaggaaacttacaatcatggtggaaggcaaaggagaagctggcactttcttcacagggcggcaggacagagtgagtgcaagcagggaaatgccagatgcttaaaaagccatcagatctcatgagaactcactcactatcatgagaacagcataggggaaaccgccgccataatctaattacctccacctggtcccaatcttcactcatggggattatggggattaaaattcaaggtgagatctggatggggacacagaggcaaattatatcattccacccctggcccctcccaaatctcatgtcttttcacacttcaaaaccaatcatgccttcccaacagtaccctaaagtcttaactcatttcagcactaattgaaaagtccacagtccaaagtctcatctgagacaaggcaagtcccttccacctataagcctgtaaaatcgaaagcaagttagttacttcctagatacaatgagggcacacacattgggtaaatatagccattccaaatgggagaaaaaggagctacaggccccatgcaagtctgaaatccaatggggcaatcaaatcttaaagttccaaaataatctccttttgactccacgtctcacatctgggtcacactgatgcaagaggtggtctcccatggccttaggcagctccacccctgtggctctgcagggtacagcccccatactggctgcttccacaggctggtgttgagtgtctgccggttttccaggtgcacagtgcaagctgtaagtggatctatgattccgaggtttggaggatggtgaccctcttcttgcagctccactaggcactgccccagtgggaactctgtgtggaggcttcaaccccacattttccttccctactgacctagcagagggtcttcataagggctctgcccctgtagcaaacttctgcatggacatccaggcatttccctacatcctctgaaatctatgcagagattctcaaacctcaattcttgacttctgtgcacccataggctcaacactatgtggaagacaccaaggcttggggcttgcaccctctgaagcaatggaccaagctgtacctttgccccttttagccatggctggagctgaagcagctgcgatgcaaggcaccatgttccaaggctgcacagagcaggagggccctgagcccaccctacaaaaccatacttcctcccaggcctctggacctgtgatgggagggccttctatgaacgtctctgatatgccctggagacttcctccccattgtgttagtgactgacattcagctcctcactacgtatgcaaatttctgcatcaggcttgaatttctccccagcaaatggtttttcttttctattgcattgtcaggctgcaaatttttcaaacttttatgctctacttcctcttgaacactttgctgcttagaaatttcttccatcagataccctaaatcatctttctcaagttcaaagttccacagatctctagggcaggagcaaaatgctgccagtctctttgctaaagcatagcaagagtgacctttactctagttctcaacaaattcctcatctccatctgagaccacctcagcctggatttcattgtccatatcactatgagcattttgatcaaagccattcaataagtctctaggaagttccaaactttcccacattttccagtcttctgagccctccaaactgttccaacctctgccaaagttccaaagttgcgtccaaattttcaagtatccttgtagcagtgccccactctcagtaccaatttaggacccagttaagctatgcctgaactcctgacacacagaaactgagataacaaatgggtgttttttaaatcatgaagtgtgtagtaatctgttacacagcaatagaaaactcatggaatatgtttaagaggcaagaacaacaaaagccagtacaactggggtatggtgggcattttaagataaaaaatgggataaattgttaggagattaggttggcgagatagatgagagtcaaattctgtgaaaatttgttgttaaaagtgggaagttttttataattttgcttgttaagtatataagaaagtcatcactgagatttaagcatgggaagaacctgattggcaatttttaaagaacattctggatgctgtgagtaaaatggattgtaggaggggaataacagaagaaggaatgagactagttagaaggctgttacaataatccggtgagaattgaagaaggctgggatagtggcaaaagaagttagatgtggtcagatagcggtcatattttttaaagtggagttaacaggaattattaatggatcaggttgagggtaagaaaaagagatgaggcccagcgcagtggctcatgcctgtaatcccagcactttgggaggctgaggtgggaggatcacttgaggtcaggagttcaagaccagcctgggcaacatggtgaaatcctgtctctactaaaaatacaaaaattagctgggcatggtggtgcatgcctgtggtcccagctactctggaggctgaagcaggagaattgcttaaacccaggaggcagaggttgcagcaagctgagatcgcaccactgcactccagcctgggtgacagagcaagattctgtcaaaaaaaaaaaaaaaaggaaaagaaaaagaaatgaatcagggatgactttaagtttttgacttgacgaactaagctgatggtgggttgtcgtttattaagcaggggaagtctatgggaggaaccagttggaatgacgggatggggaaaagcatgtgttctacttcggataagttgttttaactgcctactcatcacctgaatggtgatatcaggttagcagatggttatacatgtctcaaactgcaggcacaattcagaactagaagtaacagagtcattggcatgtaggcagtatgtaaagcaaaagtactggatgtattactttgggcaagtgtgttaattgaaaatacaaggttttctgtgcctaatccctggaaaatacaactgacatatttgaggtacagcagaggaagaggagtttgcaaaggagacttaaaaagagcagtcaaggagggaagaataaggaaaaatagtataaagtcatttaaacaaacagaagaatgtatttcaagaaagagaaaacaatcacactttatcaaataatgctgaaaggaaaaaaataaaatacattaggtcagagaagtgatcattggattcataatcatggatatttaaatggtagacttaacaaaagaactgttggagtactggttgtgatggactgcccattaaagcagagacaggacaaaatctaagtgtaaaaaaaccagaaacaataatgacagtagatatctctttcaaaatatgtcactgtgaaagggttcagagattgaagctattgtgttgtgacagctggggtcaagagattttgttttgtatggttggcggtaagatgggatatatcacagcatgtttttagaaagtacattggtatccagcatactattgcaataaaattaaagctgaccttatctgattctacctaactgaattttaatgctaaataaagccaaaactttagccagttcaggatagtcatcatatacatgatggcaaaatgaatgttaaaaaataaacaactacattgagagaagataccaggcatccagagttattcataagttaaatgactggttcctacacactggtctttcaacaaatattttttggactttttttttttttttttgagatggaatctcgctctgtcacccaggctggagtgcagtggcgcgatctcagctcactgcaagctctgcctcccgggttcacgccattctcctgcctcagcctcccgagtagctaggactacagatgcgtgccaacatgcctggctagtttttgtatttttagtagagacatggtttcactattttggccaggctggtctcgaacttctgacctcatgatctgcccacctcagcctcccaaagtgctgggattacaggcgtgagccaccatgcccagcccttttttggacatttttattcaaagttgtgagtaccaataattttctataaaagcattagaattgtcagactatgagatgggcacggtggctcacacctgtaatcccagcactttgggaggctgaggtgggcagatcactgtgtgtggtcaggagttcgagaccagcctggccaacatggtgaaaccctgcctctattaaaaatacaaaaattagctaggcacagtggtaggtacctgtaatcccagctactcaggagtctgaggcagaagaatcgcttgaacccgggaggtggaggttgcagtaagctgagatcatgccactacactccagcctgggtgacagagtgagacttcatctaaaaaaaaaaaaaaagaattgtcagactatggatggacttaccctctattttccaaccatctgtaatatttctatatggagtttcaacaaaaagtaatgacattaaacatgatactgtaaaagataaataaaacctcagctgaccaaagcatcataaatgtaatatcttaaaataataagagcataattatattaagacctacagaattatccatgtctagtgaaacataaagtaacaattttaagactaaaattgtaaagagttaatggttttcaacaaacacataccaaaaattaataattaatttttaatccatagaattttagaccataaaaagatcttacatgttattttgctcaacctattcctagtgccaaacttctttcttcagcatctctgggaaatctatgcttcagcttgaaaatgtccactaagaagctcatgctttctcaaggcaagtacagtggaacagctttcatatattaagctaaaacctgcctctcccaaacttccactcattaatcttagttttgtccttggaatgcatacttagaaagctctgaaattaaaggaacagggtctttacaaagcaaactgtttgctttcaaacttttgttactaggaatatctcaaagtgggggggaaatagtgcttctgtgcttaacaaatgagctctgtttataatcaaaaaagtaaggtttacataaattatttattatcaggaaatccctaaattcagaagtagcctatagaagttgacgttttaacaaattactaaaatcagcttttgttttgttatctgatgtggtcaaagtgttatgcatggctagatacaaatatagcaaaacttcaaactcacttcctcttttcttctaatttaatatttactgattaaatcaaattttaatatgcacttgcttctgcagtagaacagatatctcataaagacaaaactcccactgaacgtagtggtagtcatcagtgctcacagtctaatgtgcactgcaaaaacatgtagagaaaaatccattaaactacattggctattgattcttttctcctgagaagttccagccagaattcattgctatcactgtcttatgcatggtggtgcctcactaatgaaagattcagatttttttaaagggtctacctggcctaaataagatatgccacttaaaattagattcataataaaccaaacaccgcatgttctcacttacaaataggagctgaacaatgagaatacacggacacagggaggggaacaacactcactggggcctgtcgggggagggttgggggagacagagcatcatgataaagagctaatgcatgcagggcttaatacccaggtgatgggttgataggtacagcaaaccaccatggcatatgtttacctatgtaacaaacctgcacatcctgcacatgtatcccagaacttaaaataaaataaaacttttttaaaagatggtaacaatagacactggggactactagagcgcggagggtggaaggggagcaagcatttaaaaactacctactgggcactatgctcactacctgggtggagggatcacttgtaccccaaaactcagcaaagcacaacatacccatgtaacaaacctgcacatgtaccccttgaatctaaaataaaagttgaaataaaaaataaattaaaaagagaaattttttttaagtagattcataaatttcacaatttataaattaatacatatatggttcgttgttcatctcatgataaaatcacttggaaaaactccaaatgtcattaggaagatacctataagatgatgtagagtcattttatggagtctacgatatattgttaagtgaaaaacaaaagcttcatatcattcctactcgatttcaaggtgtactataaagctacaataatcaagacagtgtggtattggtgaaagaatagacaaacatattagtggaacagaataaaatccaaaaataaacacataccaatacgctcaagagatctttgacaaagtagcaaagcaagtcaatgtagatagcgtttcaacaaatggtgctggaacaactgaacatccacatgtaaaaaaaaaaattagacacaggtcttacacttttcacaaattaattcaaaatggatcataagcctaaatgtaaaatgaaaagctataaaacttctagaagataacaggaaaaaaatctagatagtgttgggtttggcaataacattttaggtgcaacactgaaaacatgatatataaaataaaaattgataaattagacttcatttaaacttaaattgaaaaattctgctctgtgaaagatactcttaagagaatgaaaggacaagccacagacttggagaagatcttggcaaaacacatatctgataaaggactggtattcaaaatatacaaagaacacttaaaatacaacataagaaaacaaataacccaatttttaaaatgggcaaaagatcttaacagctacttcaccaaagaagatatacagatgccaaataattgcatgaaaagatgcgaataccatatgtcactagagaactgcaaactaaaacaacaatgacataccactacgcatctaccagaatgactaacatataaaacactgacaacaccaaatgctggtgaggatgtggagcaacaggaactctcattcattactgtggaagtgcaaaatggtacagccactttagaaaacagtttggaagtttcttacaagctaagcacaatcctaccatgtggtctagtcatcacactggatttatttcatttgagaatttatccaaatgaaaataaacccacagaaaaatctgcacaggaatgtttatagcagctttattcataattacccaaacttggaagcaactaaaatgtctttcagtcagtggaacagataaacaaactgtggtatatccatgcaatgaaaaattattcagtggtgaaatgaaataagctttcaaagcatgaaaagacataaagaaaccttaaatttatattactaagtaaaataatccagtctgaaaaggctacttactgtataatttcaactatatgacattctgaaaaggcaaaactatggagacaatgaaaagatcagtggttgccaaagttctgggggataaagcaagggatgaataaggagaccacaaaaggtttttagggtagtgaaactattctatatgttactgtaactgtggctacatgacattatggatttgtcaagagccacagaactgcacaacacaaagagtaaaaccctatataaacaatgaactttagttaataataatgtatcaatatcagttgaacaattttaacaaatataccacattaatgtaagatgttaataacaggagaaatgggagaggtagcaggtatatgggaactctgtactttctgctaaacttttctgtaaacctaaatttactctaaaaagtaaagtctattaatttttttaaatctataagcaaaaatgtatgcatacatagcatgcttttgattaagaaaaacggggcagaaaacataggaaggataaaccagaaaaacgttagattacctatatggggtgggtagaaagagcagaaggtataggaaagaggtaggatttctctgagtatacctgtttatatagttttgatgacatattaatattttatataataaaaacaaaactaaatcaacaagaatgttgtggaaagtccttataatttgctaaaaacaaaaacatataaacctaattatatatcaaatagataactatatagaataaaataaaaacaaattaatccaagaacgttttgaatacaatactgtttccaccctcagtggaaatattctaaggaccaaaataaccgcaaataaaccttgaatttcacttggtaaatttggtggcattgctggtattgtacagcaatttaagtgtgtgtgtgtccgtgtgtgcatgtgtgttgcacaagcacatgtacatgtgttaaaaatgagtaaataggcggttacactgacactattgggaactgggattttcaccatgaaagaaaggaaatacaaatatggattgaggaacagacagaatttgtggctgaagagaataaatccatgacttaagaaaaaaaaatgctttctaccattacctactaaaaggttcccgaagcaataacactctacagcaaacaataagttcctttgctatatatttaagcctcgggtttatgaatctaacattgcgtcttatctgtagttgggacatgctgtttcattcttggaaaatttctttttcctcttttttacctgcttaatgcttactcattcttaatgtttcagctaaatatgactatttctggaatataataaattaccatcgatttctctccttaaggcctatgatgacttcacactacttaatagatatccagatatacacactctgcccatggttttctttatcagattgtgctggactatcttatctagcttgttttcttcctactgctgttctgtgtgtgtgtgtgggtgtgcacgcacgtgcgcaagcacatgtgcgtgctctttattagctctaacagattttcttatttttcaaatttattcattcacttattttttcattcattcagattcattcaatgacacaggcagtgtgccagtgagtctcccaagttccattctatacttgggaacatttcattgcccccctgccacccacttcacacagacacatacgtgtgtgtgcatgtgtgcacatgtgcacacacactgctgaaattctacttctgtaaattcttcaattaatggaagagaagtcaccatttttccatgtgttttttctttctaaaattgtgccatccatgaatctaccattcaaataacagtgattcttttcataaataattacttacttaatttatgttttgctcagctctatctcttcagtgctgactttcttaagctataaaatcctggagagtaaaaatatatgccttttcatcccctttgcccttagtccagcacctgagaagccgttaagaaataccaacaataataatgcattatgcacagtggttgcacaataaatattgacagaatgaaaacaatacccttaataaatgtgaaagaacagagtcttcttgtattgctgttttaaatatcccgtaacttctggtcaaatctccttacttgctaaacgatacaaaaattaagtaatttgtaagacttgctcaagattttatacttcaggatagagtgtatattcatcaatgcaagtaactaaaatgtagaagagtaaaatgaattttgataaagttattccattttaatttcaacacacaggtgctggcactgataaatgtaacctgaaggtttaattcagagaaatctttgccttcaagcatatttaaaataagctgtttgcattttcctgcatataattattctaaccctgaaagcaccttttaaatatggattacaaatccagctgccttaaaatgaaagtaaaaggttttcctttctcagtctattttgtaagttggaaattaatgtaacagaactattttgagcttagagagttaaaccttctgactaaattcatgcttaattttttaatgtatttgtgagtttaccaaggtttgcacagaagacaacttttaaaatatcaaaaaaattaacaatgcttcatttttttaacattgtaatttttaaaattagtcatctctcctcctagagggatacttcacaaaagaggcatcccttgatcaggcagggtttactcagccaagtgcttggaatgaacccagaggaaccaaaagccctgatatttctggtatttatttgcaagaaacagtagtctccccatacccataggggtgagttccaagacccccagtgaatgcctgaaactgaggatagtacccaatccaactgccatcaataggaacatgcttcttttcatgtattctactcacaaactgaaagcctttgccatattgactaaggatttattacacactgtggctgtaccttttgcagtttgaggtgcaacaacaaagcgagcacgaattttttttccttctttacaatttcatgaatggaagtctcatccctaccatagatcttagcaacctcagcacataatattttttttctttattgagaactttcaccttttcacttaaagcactttacagcttctccttagcatatcccaattgccagcatcattacttttgtagtggtaccacaggtaactgaaaccacgaaagtgaaaccctggataaaggggaactactgtattcccattctaattgctaggatcctgttcctaactggaaactaactttagaatatgctagagaatttatgttctgcaattcaataaaacatgtgattgcccttgacagtctcaggtcattgacttgaagcagaaagttttgcttaatgactacagagcagtcttccaatccccacctgctgaactggtgcttatctcttacttgtaatatcttgtaaggaatgcaagaaacctacaaactctactattctgattatttctacaaaggtgacctttggtgagtacgtggtctaagtcccaagaaacaacacattatagtttaactttgttaccacacttcaataattgtttctcaacctggtatatagaaattctaaccaggctcctgatccattttgcctatttcatatcttagaatctcttggttgtgccaccacttcctgacaccagttgagacactttggggttgcaagtgggtttgcactttggggttgcaaaatccaactcaaactagcttaatcataaactggaatgtattatctcttggaatccagggaaatgctaaacaatagtatatagatgagcctcaataaaaatgaaccaacaacagatatgctgctgctgctttttttaaatcttgtatttttttatttttatgggtacatagtaggtgtatatatttatgaggtacatgagatacttttatacaagcatacaatgtgtaataatcacatcagggtaaacgaggtatccaccacttcaaacattcatcatttctttgtgctacaaacattccaattgtattccctcagttattcacaaatgtacaacatattattgccgactacagacaccctgttgtgctattaaatactagatcttattcattgtatctaaccatattcttatactcattaatcatttccccatccccgcccccaacactaccctttcccagcctctggtcaccatcattttactctctgtccccataagttcaattgttttgatttttagatcccacaaatgagtgagaacatgcaaagtttgtctttctgtgcctggcttatttgactttatataacgtcctctagttccatccatgttgttgcaaatgataggatctcactttttatgtctgcatagaactccatcatgtatatgtgccacattttctttatccattcatctgttgatggacacttaggttgcttccaaatcttggctattatgaatagtgctgctgtaaacatgggagtgcaggtatctctttgatatactgatttcctttcttttgagtttatatctagcagtgggattgctggatcatatggtagttctatttttagttttttgaggaacctccatattgtcttccatagtggctgtactaatttacattcccaccaatggtgtatgagttttcccttttctccacatccttgcctgcatttgttattgcttgtctttttaataaaagccattttaactggggtgagaggatatctcattgcggatttatttgcatttatctgatgatcaatgatgttgagcaccttttcatatacctgttggccatttgtatgtcttcttttgagaaatgtctattcagatcttttgcccatttttaaatcagattgttgtatctttttcctgttgagttgtttgagttccttatacactctagttattaatcccttgttataggggttgtctgcaaatattgtctcccattctgtgggtcatctatttactttgttgattgcttactttcctatgcagaaggttttgtttgattgccttttttttatttgagacagcgtcttgctctatcgctcaggctggagtgtagtggtacaattatggctcactgcagcctcaacttcccaagctcaagcaatcctcccacttcagcctcccaagtagctgggaccataggcatgcaccaccaaacccagctaattttttttttttttttgtagaggcagagtttccctatgttgcctaggctagaagctttttaacttgatgtgattacatttgtccatttttgctttggttgcctgtgctttggggttattactcaagaaatcttcacctagaacaatgttctagagagtttccccaatgttttcttttagtagtttcatagtttcaggtcttagatttaagtctttaatccactttcatttgatttttgcacatggtgaaagacagggtctaatttcattcttctgcatacagatatccagttttcccagcaccatttttgcaatttagatttcattctctttcattataaattttgtttctccacaaggcaagaaacataaccatcaaacatctaagttttatatcttaaagtttctttggccattaaaggaaacattgactctctttctcttgattccagttttaaatttcctgaaaataattctgattggcctgacttgaattagatcaatctgaaatattccattgttgagatggcataaagtggccaactgtcctggtttgcctgaaactaaagggtttcctgggatacaaatgcattgactctgatactactgttgattatttgtaatagtaaatgaaacatcatgtctaatgtattctgtgtgcttcaaatctttttaaaagaaactgaattaactaactggcatccattgctcttctcaaaaatgtttttatattttgactgaaacccaccatgtgttatggttatctcctttctttacgtttcagtatccctgaaacatattatcctgtttcacgcctcgtatctttacatatggtatttccacccctccctccttattcatgtgtcataatcctcttcatttaaactcagctcagacactgcttttgtgaagtcattgtgaatcctgttctcctcccctgggagagttagtcattccctgttttgttctctactcccaggatatatttctgtacttgtctcataattctgttttataatgatttatttacaaatatatctcatcactatcctataaggtatatgaggccacatctttatattcccagtgcctagcgcaaagcctggcataatggcagtatccccataaacgtttgataaatcgaaaaatctaaaataggaatattttaaatttggtttggggcatcaggtatcatgtacctattatttctatgatcagtctctgaataatagccagtatatctggcatatttgttaacatttaaattacaaatgatagcgtatcaagaataatgtgattactaaaaccagtaacgtgatttgggcctttaaagaagttaatttcaagcttgactttgctgtaggcccaaagtttataacttgttcctaaatagaagttaaatgataccaaaatagatgtataaataagaacagaaagtatgaacataatcagccctgttctctgacaggtgggttggaggctgaggatgcatcaaacagtaaggaaagtcctctgtgggctaacgtgggagggataatttggcttcctctctccacaggcagatggaggccttttccccctgcatagtttctgagaatgcaatgaggaaagatgattgggatgctcatgtggaacaagcatactatttggcttacattaaaaaatagaatgaaatgagtatccctagggagaactaacttacccaagacacttcaacatttctagactcatttctctgaaacagtctagaaatagaaatatatacacatattagactacatctagaaatgtatttgtatatgtatttctagacacacacatacatacacatacattacataatatatgcatacacatacatatacacacacacacacacaaactctctaatgaaaactgtgccaatttcaaaagtgaagctaaattatatttcagttatgctcccttgcatcacaaaatgaggctctccagcttaatattggcattcccaagccaggtcaagaaagtaggaactgataagctgtctggtataatagttctctagctaaatctctagaaaggtgctgcatctgacatttcttcaaattagaggaaatttcataagacttggtagggaaaaatatgtcagatgacagatatgtatatcttctttcacttttgcccaaaacgtcattaaaatgatagaaatatatttgtaaaggcataaagacataaagacaagcagaacaagaaaggaaactacagtaacaaaattctggatgctataaagtagttacatgacaaatgactaagcagacttgagaactggatccaaagctagccatagaaaaaactaaaaatcaacctggtaagactacagaggactcatgaattccataccagatatgtctgaaagaataggtgaataaaaaggcaaaaatagcaactatgtgaaagaatattttaaagcagttagattcccatatgcctttctcactctatagcctggtgactatccgtccctcaatcttgcaaaacactgaagatttcttctcttagaagagtaaaacagttctctaaactaatcacagtttagggtatggtaagataatgaaaataggtgattgagaaaacaggtatactggatgttgacattcctgtgtgccctctttccttaaacagccctaagaacttcccattaggagcttaaaagagggatttcctaggatgttccggtcaaaaggaaagatctaaagatgctgttgtcaagacttctccaactaaacggaccaatggaatcaacctaaagcaaagcttatagtgacaatggcatctagaagacaatatggtcattgttttaatttctctagggaatttattctcaacactagaatttcacatccagtctatgaagcaagagtgaggacagaataaagacatttgcatgaaattactgggagatgtgctgcataaaacaagaaaaggcatggcatacagaaatcaagatatccaacaaaggaaagaggcaataaaaatccccaaatgatggagaagaattgcaaggttgatacctatcagaaggagtagaaggtgaccagtccggatttaaatgaatggaaaggctcaggtgagattcttcagagacatgaagcatatagaatacctgatacacataaacatgttaagaaaagatgaatctggaattgtgttgactatatatacatagaaaatcaatcacaattaggaaagacaataattaatcctaggggaaataaaacattgtaatggaaaggaagaggaatcagggtttagcctatggatcagtaacattataaataatgtctgtcgacaaacataacaagtaaatagagaagactaatctaacccaaattttgcaattaatgtgttaaagagatagtcatggaaaacatgtgtgtgcttgtgtggggtactgttatagtaagcggtaggaaagagaggaatgccatattccatagtgggatgtcaatagataatgtctaaaactgaaacattaaaaaggagcaaaacaaatagattagagacataaagataaatacccagataactagataaaagagatgaaggtgttgggaggaagagaagaagatggttggggtactgctttttaaaataataataaataatatataaatatttgacaattcaagtaaaatcctctaaaacttatataatcttgactttatgatattatataatttacctaaattgaatgcatcaattctcacccataattactttttgtaagctcaaacattaagaatttggcaatgtcttataactcgcttctgtgttagggacctatggcagaaaaactctgaaattacccccaattatccctgtttctcatgcctttgtgtaatcccctccccttgagtggaagcagaacctctggtttgtttctagctaatagaatatgacaaagacaatggcatgttaattccatagttatgtcacataagattgtgacttccattttgcaaacataccctctgttgattctctccctttctggctttgatgaagtaagctaccatatggaaaggccatgtggtaaggaactaagggaggcttacaaactgaggctctcggtcaaggaattgaaagcattcagcaaggaactggggtcctccattgacaaaccacaaggaactgaattctgccaacagccatgtgagcttggaaccagatccttccccagtcgagccacagacgaggtcccattcctgggtgacaccttgattctagtcttgtgagagaacatgaaacacaggacccaagccatgcttgaatacctgacacacgaaactgtgagataataaatattttgcataaggcactaaatttgtggtaaaatggccacacagcaatagatgaataaaggatctaaccaaaagagaccatgatttgagcacctctccaactcaggtgttacaaaacaaagattgttgagttctgcttgtcagaggtatgaattctgactgattgcccaagcctccagtttgtttgcatcatccagctacttaagctgacactgctacacctaaggttcagcacggcaacctcagatgacttcattctgggctacgtcatccagaagtcataaaattatctcccaaatattaaagaatttaaacaaattactatctttagcagtgccaatcaaatgtcacccaagaggtaaagtaatattcacttcagtattttagagggaaaagtcataagaggtaacacataatagaaatcttctatttaataaaatgttaagagtagatgggaaaaatcaagtttttcaccctctaaaaagcatacattctaattacaacacattaaatatttaacaaatcctgagttctaggtaaatggaaaggaaatttcctttgcttttaatttagaataaaaggtgatatgtgggtggtgaaatggtgcagcttacagtgcctacattattgtacagaaagaaagggcagcagggagctagaattatagaagcaggaaaaaaatggtatgacaaccaggtaggcagcaatagccatttgactctctacctaccagctctcataggcttcgctgtcttagagttattataactatattgctaaaggaaaaaaaaagtgtggttatttgttacttagctgtccttatcacactgactcagaaatcaggtgtatgtgtgggagaattttcaaaagaaaatccacatacagctgtgaatcactcacctgaagaacaatgagccaaatgggcaatcactgagacaaactgtcacttatcaaaactctataagcaatgcggaggttaacctgggggtctgaatctgtcagtgccaagtttcttccagctgtcacaatcagacaagctgcctccatcataaaataatgcaagccaaattcaactgagtgggactcaaagaaacatctgaaattcaacaacagcagccttgccatctagactattttgtgacaaagttgatgacaaggggttggaaatgacagaatacatcagtatggaagtctctctttaatgacccgatgtcatgaatgaagcatgaaggacaagtgactaaacacatatcattcttatttaataccatattgaggactaaggctcacattatcctctacaggtactgcttggatcctgtattagtttcttttgctgctgtaacaaattaccacaaatttagtggcttaaaacaatacaaatgcattctctttcagctctggaggccagaaataaaaagtcagtttcactgggctaaagtcaaggtgccacaagggctgcctcctctagaggatctgggaataatctgtttcttgactcttccagctactagtggctatgctatgggtattcctcattggctctggctcatggccccttcctcccatcttcaaagccaacagtttagtatcttctatcattgcatttccttattctttctgtagtctattccccctctacctccctcttataaggacagttgtgattacatttagggtccacccagataacccagaattatttccatatctcaaaatcctaattcacatcacatctgcaaaggctcttttgctataaaaggtaacattcacagtttccaggaattccaacctggatatttttgggagctattattcagcataccacaggtcctgtctcataaatgttttaattggaagctgttcgtctgtggtaaagagtttattactcatatacaaagccatctaaaatacaataaatgtaaattaattagagattgaaaatcaatagtattttgactcctaaacactttattaattgttctgggaaatttttgagccatttctcttggtaaacataatgtaaaaaaactaaagagcagattttagtgggtcaatattatcttggcaatctcatgaatactgctgtgtgtgtgtgcacgcacacatgcacacataagcacacgcaagcttgtgagggtcaggagattggataaaggtatactaaaagtgaacacttaaagaattctaatgatacctgcatgctgtactcatggaatgattcacactataacaactatgggtgctggaatgtacttcagtaagcatcaggcaattttaattcaaaagactctgagcagattttgaagcagttgctctgacacctgagggtgtaaccatgtttgaaggtgtgtgggatgttgagaggagaaggaactaacttttattaaatggctactatgtttcaggtacagagttacaggttttacaaattttaatgttaattaaggctcacgacaacagatgctgcaggtattaaaagaagataataatacccagagaggattaggtaacttttccaagtttgccagctagcaagtggtatagctagacccacattttttgaaatctaaatatccataatggggttttagcatgttagagcagatataggagaggtcaagagtcaagaaaacacaatggttctttcagaagagctctggggaaaaaaggaatgagacaaggggaacaacattatcacacactgcaccagctgactatagtggtaggtcataatgactgcaaaacagtgtgctgggccccatttagtgatgacatcacaatacataactctaagcaaataatgtttctacttctgattcctatttcactgctttgaccctccatcacttacctgggcacagagtattcatggtatcacttctccccataaaatgggtttgacaaccaagcccaatttcttacttcatcctcagatgtagccttatacctttaaatgaacagagattaattgcatagattttccataatggggctcattcattttccgtattatagtatctactttctaaagctgattttactgagatctaattttccagctcatgccactatagaaatgactgttaaaaacttgatccaacaggaatctgagtcattgctacaatgggaaaacatctgtaccataaagaagacaagattgtcatttcattagaattcctcttgactttaaaccattaatctttgtcaataatgggatattcatttgcagctcactaactggaataaaactgaaagtgataccatcaagatatacataattctttgataaaaccacagctttagggtccatgcctccaaggataattaaagaaatagctgttggtgttctgagtctgcttgagtaacctatagtttatgggataaaagagatagattaagacagggcgaatccaggccaagacttcactgagatctcaagtctatgtattgtgaacatatgttttgtgggggaaatgaattaggtaagacatgtcatgaaacgaaggactgagagtcaatgtggttttttctttataataccttcagtagcaaaaattcctttccttatttataggcatcctttcatactttgcctttatcatagagaagaatatatctctggtcctttttagtcaatatctatgaacagctgaaaatacaatgaaagtaagaattgcttcccaaagttcctgtttgcatttccgtttatttacatatgttcctttagacctatatagacccaaaacaacctgagataaatgccactcataactgtatccctcaggggagcatataattaacaaaagcccatatatttgagcttaactgattaatcattttccctcaactctttccattataattcagtttgctttgtgttaattcctttttttaaataatctctcaactcctcctatcacccaggctgaaaaacccaggaatcaccaaagaccctctccctcaactcctgcagccaaagcccagtccaacagaatctatccaacttccttatttcacttttccagctctgattggatttgtatctataataaatcaaaaagaggtcaactaagaacaaaactaacatcattagaataaaatcaccttataaactggaatgcaaggtgctaatgttattacttttcattctgataaaatcaccttataaactggaatgcaccatgctaatgttattacttttatcttttttttagtttgtactgcacatcacagttttaatttttttaacttttaagttcatggttcatatgcaagtttgttatataggtaaatttgtgtgatgtgggtttattgtacagattattttgtcacccaggtactaagtctagtactcattagttatttttcctgatcctctccacccttccagcctccaccctctgataggtcccagtgtatgttgtttccctctatgacttaaacaaaatgacaaaaaagagcaaacaaccacatttaaaagtgggcaaagaacgtgaacactttcctaaagaagatatacctgtggccaacaagcatatgaaaaaaagctcaatatcaatgatcattagagaaatgcaaatcaaaaccacaatgagataccatctcgcaccaatcagaatggctattattaaaaagtcaaaaaaatagatgctgtcaaggttgcagagaaaagggaacatttatacacagttggtgggaatgtaaaattagttcaaccattgtggaagacagtgtggaaattcctcaaagatctaaagacagaaatacaattcaacccagtaatcccattactgcatatatactgagaggaatataaatcattctgtcataaagacatgcacacatgtgttcattacagcactattcacaaaagcaaagacatggaatcaaactaaatgcccatcaatgatagactggataaagaaaatatgctacctatacaccatggaatactatccagtcataaaaaataatgagatcatgtcctttgcagggacatggctggagctggaggccattatccttagcaaactaatgcaagaacagaaaaccaaacattgcctgttcgcacttacaagtgggagctgaatgatgagaatgcatggacacacagaggggaacaacatattatttttatctttacttgaaaagtatgtcttgatttcctccatataaaattcaagaccttggggatgcagacaaaataggttgtttcatgtggggtttatgataggctgaataatagccctttcaggatggctacatcctaataaccagaacctgtgaatattttaccataaacacacatcacaaatggacctatgaagctacaattaaggttcctgagagtgagagattattatggattatctggatagacccaatgtaatcacaagagtccttaaagaaggaaaaaagggtcagagtcagacaaggtaatgagaagagggcaagggccccaatagtctcaaccccttataacatacattcaaatacaaaataccatctaaatctcatcagcttaaaagtcccaaaccttatcatctaaaggatctatgggtgaggctctggatataatctatcctggagaaaaatacctctccatctgtggatctgtgaagctagaaaataagttatcagatcaaaaagtacaatggtggcacaggcataagataatcaatatagacattctcattgggagaaaatagaaggggaaaaaggggtcactattcccatgacattttgcaatccaactgggaaaattctatcatgtttcaaaacccaggaataatcctctgtggctggagggtccatcctctgggcccgtggctctgccatgacctcagagttatccttcttttcatgaagggtaatgtgtctaaacctgagttattttattagcctgttttctaactggagaattttggaagtcaaacaaacttctatcattttgttctttctctgtctctttcagtccaagctggcagtgtttctgctgatacaacattctcaaaaactttgtgggtctcccacacatgttacagggagtaaatccatcaaacaagaggctcttccacaaatatatgcaggataatcccatttttattcctggctcctattgagatctgtgaggggatccatgagtcatatacttaatcttttcaaacacttttctgtgtgattaaaatactgaccttatctaaaatcgttccaaggcacaagcaaaagactgctcagccaaacctttggcattctctccagagcatactttcttgtaatcaaatcttctaactttagcagtttttgaaagctgaatagactgagaatttcctaaattatcaagtcctagttcctttttgtttaacagttcttcccttaatctatgtctttcctctcacattttactataagaaacaagaaaccaagccacattttcaacagtttgcttggatttccaagcaaatttcctcggctaaatctccacgctcatggcttagaaattctatttcccacatgactgcagaacaaaattctgctgagtcttctgccaccaaataacaaagaacccttaattccatctgggccattatgaggagttcctttagtattcctatttctatagtttatttataatagctttaatattctctaagacaatttaatttttctctattatgttcctcacttccttctgagcccttactagcagagtccttagtatctatatttccactagcaatctgttcacagaaatctaggcttttctatcatgctcctcaacattcttccagcctcttcccactggaaatcacaaccacatttttaggtatttgttagcgcataacctcacttccaaatctatgttagcttcctacttctgctccaataaattctcactaacttagtggcttgaaacaatgcacatttatcttctttttctggaggttagaaatctaaaatagattttgaaatgtactgacatttatgagtcttacatgactaaaattaaagtgtcataatcttcattccttatggatactttagggaaggatccattccttgcctttcccagcttcaaaaggccgcccgcattccatggctcatggctacatcacttggatctccgcttctgtcatcacatctctttctctccctctgcttctgtcatggcattgctttttatgacactacccctcatgccttcttctcataagaacccttgtgatttgtctggacccacagaagtaatccaggataatctcaagaacattaacttaatcacctgtgaagccctttttgctatgtagtcatacctcattttattgtgctttgctttattgctctttgcacatattgcctttttacagattgaagttttgtcacaaccctgcatggagcaagcctatcagcaccatttttccaacagcatgtgctcacctcatggcttggtgtcacattttgataattctcacaatatttcaagttttttattattattatattttttgtggtgatttgtgatcagtgacctttgatgttactactgtaatcacttgaggcaccatgatccactatcacatagaatggtgaatttaatcaataaatgttgtatgtgttctgactgctccaccaaccagcctttgccctgtcttgttctttctccttgggcctcctagttcctgagacacaataatattgaaattagactgataaataaccctataatggcttctactgttccagtgaaaagaagagtcatacatctcattttaaatcaaaaactacaggcccagtgcagtggttctacctgtaatcccagcactttgggaagccaaggcagacagatcacttgagctcaggagttcgagaccagcctggccaacatagtgaaatcccatctctattaaaaatacaaaaaaaaaaaaaaattagctgggcatggtggcaggttcctgtaatcccagctactcgggaggctaaggcaggagaatagcttgaacctgggaggcgggggttgcaataagcagagattgcaccactgaacttcagactaggcaacagagcaagagtccatctaaaaataaaaaataataaataaataaataaaaagctacaaatgattaagcttggtgtcaggcctcgagcccaagctaagccatcatatcccctgtaacctgcacgtacacatccagatggccagttcctgccttaactgatgacattccaccataaaagaagtgaaaatggcctgttcctgccttaactgatgacattgtcttgtgaaattccttctcctggctcatcctgactcaaaagctcccctactgagcaccttgtgacccccaactcctgcccaccagagaacaattcccctttgactgtaattttcctttacctacccaaatcttataaaacggccccacccctatctcccttcgctgactcttttcggactcagcccgcctgcacccaggtgattaaaagctttattgctcacacaaagccagtttggtggtctcttcacacggatgcgcatgaaatttggtgccgtgactcggatcaggggacccttggagatcccttgggagatcaatcccctgtcctcctgctctttgctccgtgaaaaagatccacctatgacctcgggtcctcagacccatcagcccaaggaacatctcaccaattttaaatcgggtaagcagcctcttcttactctcttctccaacctctctcactatccctcaaccactttctcttttcaatcttggcaccacccttcaatctctcccttctcttaatttcaattgctttcattttctggtagaaacaaagaagacacattttatccgtggacccaaaactcaggcatcagtcacagacttgggaagccagccttcccttcatgtttaatcattgcagggacgcctctccatttacccacgtttcagaggtgtctgaccacgcagggatgcctgcctcggtccttcacccttagcagcaagtcccgcttttctgggggaggggcaaaaaccacaaccccttctctccctgtctctaccccttctctgcttttctggggtgcaagaaccccccgatcccttatttccgtgccccgacctcttatctctgtgccccgatcccttatttccatgccctgacctcttatctctgcaccccaattccttatttccatgccctgacctcttatctctgcgccccgatcccttatttccacaccccgacctcttatctctgcaccccaaccccttattttggcgccccgacacctttcccacttttctggagggtaagaacctccgaacctcttccctccatgtccctactctctcttttctctgggcttgcctccttcactatgggcaaccttccaccctccattactccttcttctcccttagcctgtgttctcaagaacttaaaacctcttcaactcacacctgacctaaaacctaaatgccttattttcttctgcaatgccgcttgaccccaatacaaactcaacagtgattccaaatagccagaaaatggcactttcaatttttccatcctacgagatctaaataattcttgtcgtaaaatgggcaaacggtctgaggtgcctgacatccaggcattctttcacacatcagtcccttcctagtctctgttcccaatgcaaatcgtcccaaatcttccttctttccctcccgcctgtcccctcagtcccaaccccaagcgtcgctgagtctttctaatcttccttttctacagacccatctgacctctcccctcctcgccaggccgagctaggtcccaattcttcctcagcctctgcttctccaccctataatccttttatcacctcccttcctcacacctggtccagcttacagtttcattccgtgactagccctcacccacctgcccagcaatttactcttaaaaaggtggctggagctaaaggcatagtcaaagttaatgctcctttttctttatcccaaatcagatagcatttaggctctttttcatcaaatataaaaactcagcccagttcatggctcgtttggcagcaaccctgagatgctttacagccctggaccctaaaaggtcaaaaggctgtcttattctcaatatacatcttattacccaatctgctcccaacattaaataaaactccaaaaattaaattccggccctcaaaccccacaacaggacttaattaacctctccttcaaggtgtacaataatagggtagaggcagccaagtagcaacatatttctgagttacaattccttgcctccactgtgagacaaaccccagccacatctccagcatacaagaacttccaaacgcctaaaccgcagtggccaggtgttcctccaggcccgcctcccccaggagcttgctacaagtgccagaaatctggccaccaggccaaggaatgcccacagcccgggattcctcctaagccgcgtcccatctgtgtgggaccccactgaaaattggactgttcaactcacctggcagccactcccagagcccctggaactctggcccaaggctctctgactgactccttcccagatcttctcggcttagtggctgaagactgacactgcccgatcgccttggaagccccctagaccatcacggacgccgagctttaagtaactctcacagtggaaggtaagtccgtccccttcttaatcaatacggaggctacccactccacattaccttcttttcaaggcctgtttcccttgcctccaaactgttgtgggtagtgacggccaggcttctaaacctcttaaaactccccaactctggtgccaacttagacaatactcttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccatgttagccaggatggtctcgatctgacctcgtgatccgcccgcctctgcttcccaaagtgctgggattacaggcgtgagccaccgcgcccagccgacaatactcttttaagcactcctttttagttatccccacctgcccagttcccttattaggccgagacatttaactaaattatctgcttccctgactattcctggactacagctgtatctcattgccacccttcttcccaatccaaagcctcctttgcgtcctcctcttgtatccccccaccttaacccacaagtataagatacctctactccctccttggcgactgatcatgcacccctcaccatctcactaaaacctaatcactcttaccccgctcaatgccgatatcccatcccacagcatgctttaaaaggattaaagcctgttatcactggcctgttacagcatgggcttttaaagcctataaactctccttacaattcccctattttacctgtcctagaaccagacaagccttacaagttagttcaggatctgcgccttatcaaccaaattgttttgcctatccaccccatggtgccaaacccatatactctcctatcttcaatacctccctcaacaacccattattctgttctggatctcaaacatgctttctttactatgcctttgcacccttcatcccagcctttcttcgctttcacttagactgaccctgacacccatcaggctcagcaaattacctgggctgtactgccacaaggcttcacagacagcccccattacttcagtcaagaccaagtttcatcctcatctgttaccaatcttggcataattcttataaaaacacacacgtgctctccctgctgattgtgtccgactaatctcccaaacctcaatcccttacaaaacaacaactcctttccttcctaggcatggttagtgcagtcagaattcttacagaagagccaggactgcaccctgtagcctttctgtccaaacaacttgaccttactgttttagcctagccctcatgtctgcgtgcagcggctgccgctgctttaatacttttagaggcccttaaaatcacaaactatgctcaactcactctctacagttctcataacttctaaaatctattttcttcctcacacctgacacatatactttctgtttcccggctccttcagctgtactcactctttgttgagtctcccacaattaccattgttcctggcccagacttcaatccagcctcccacattattcctgataccacacctgacccccatgactgtatctctctgatccacctgacattcactccattttcccatattctttcatgttcctcaccctgaacacacttggtttattgacggcagttccaccaggcctaatcgccactcaccagcaaaggcaggctatgctatagtatcttccacatctattattgaggctactgctctgcccccctccactacctctcagcaagccgaactcattgccttaagccctcactcttgcaaaagcactaaaagtcaatatttatactgactctaaatatgccttccatattctgcaccaccatgcgagaggtttcctcactacacaagggtcctctatcattaatgcctctttaataaaaacgcttctcaaagctgctttacttccaaaggaagctagagtcattcactgcaaaggccatcaaagggcatcagatcccatcgctcaggacaatgctcatactgataagatagctaaaaaagcagctagcattccaacttatacccctcactttcagtttttctccttctcatctggccactcccacctactcccccgctgaaacttccacttatcaatctcttcccacacaaggcaaatggttcttagaccaaggaacatatctccttccagcctcacaggcccattctattctgtcgtcatttcataacctcttccatgtaggttacaagccactagcccatctcttagaacctctcatttcctttccatcatagaaatctatcctcaaggaaagcacttctcagtgttctatctgctattctactacccttcagggattgttcaggcctcctccctttcccatacatcaagctcggggatttgcccctgcccaggactggcaaattgactttactcacatgccccgagtcagaaaactaaaatatctcttagtctgtgtagacactttcactggatgggtagaggcctttcctacggggtctaagaaggccaccgcagtcatttctttccttctgtcagacataattcctcagtttagccttcccacctctatacagtccaatagcagaccagcctttattagtcaaatcagccaagcagtttttcaggctcttggtattcagttaaacctttatttcccttacagtcctcagtcttcaggaaaggtagaacggactaatggtcttttaaaaacacacctcaccaatctcagccaccaacttaaaaaggactggacaatacttttacctctttcttttctcagaattcaggcctatcctcggaatgctgcaaggtacagcccattggagctcctgtatggacgctcctttttattaggccccagtctcattccagacaccagaccaacttggactgtgccccaaaaaacttgtcacccctactatcttctgtctagtcatactcctattcaccgttctcaactactcatacatgccctgctcttgtttacactgccggtttacactgtttctccaagtcatcacagccaatatctcctggtgctatcccaaactgccactcttaactcttaaagtaaataaataatctttgctggcagggctatgctgaacctccttaggcactctctaattagatgtcctgggtcctcccaattcttagacctttaatacctgcttttctctttctcttattccgttcagtttttcaattcatacaaaactatatccaggccatcaccaataattctaaatgacaaatgtttcttctaacaaccccacaatatcaccccttaccacaaaatcttccttcagcttaatatctcccactctaggttcccacgccgcccctaatcccactcgaagcagccctgagaaacatcgcccgttatctctccataccaccccccaaaattttcgtcgtcccaacactttatcactatttcattttatttttcttaatataagaagacaggaacgtcaggcctctgagcccaagctaagccatcatatcccctgtgacctgcacatacacatccagatggccggttcctgccttaactgatgacattctaccacaaaagaagtgaaaatggcctgttcctgccttaactgatgacattgtcttgtgaaattccttctcctggctcatcctgcctcaaaagctcccctactgagcaccttgtgacctcccactcctgcctgccagagaacaacccccctttgactgtaattttcctttacctatccaaatcttataaaacggccccacccctatctcccttcgctgactctcttttcggactcagcctgcctgcacccaggtgattaaaagctttattgctcacacaaagcctgtttggtggtctcttcacactgatgcgcatgaaacttggtgaagtatgtatgtcaaaagctgagataggctaaaacctaggcctcatgtgccaaacagttagtaaatgcattatgtaagaaatacatttcaagttgtgaatgcaaaggaaaagttcttgaaggaaattaaaagtgcgactccagtggacacataaatgataagaaagggaaacagcctgaatgctgatatggcaaaagttttagtgctctggaaagatcaaaccagccacaacatttacttaagccaaatgctaatccagaacaaggccctaactctcttcaattctatgaaggctgagagaggcaaagaaactgcagaagaaaattttgaagctagcaggggttcatgaggtttaaggaaagaagccatttccatgacacaaaagtgcaagaagcagcaagtgctgatggagaagctgtagcaagttatccagaagatccagctaaattgataaaggtgactacactaaacaacagattctcaatgtagatgaaacagccttctattggaagaagattccatttaggactctcataaccagagaggagaagtcaacgtctggcttcaaagcttcaaagaacaggctcactgttttgttaggttgtaatgcagctggtaactttaagttgaagccaatgctcatttgccattctgaaaacactaaagcttttaagaacgatgttaaatgtactctgcctgtgctctataataaaataataaagcctggatgacagtacatttgtttacagcacagtttactgaccattttaagcccactgttgagacctactgcttaaaaaaagattcctttcaaattattattgctcatcgacaatgcacctaattacccaagagctctgactggaggtgtacaaggagactaatgttttcatggttggtaacacaacatccattctgcagccaatggatcaagcagtaattttgactttcaagtcttatgtaagaaatacagggtgggaccaagatggccaactagccaacaagaagcagccaccgtcagaggctcccatcaaaaagaaccataatagcatgtgaatcctgcactggcaactgaggtatccaggttctctcatcagaactgactaggcagctggtgtgacctacagagagaaaggaagcgcagtggtgcagggggcccacctgagagccacacagggcaggtgggtccccacccccccgccaagggaggtgatgagtgagtgtgccatccagcctgggaaaccatgctttttccacagactgtgcaacctcctgatcagaagatctcactcatgaaatcacaacaccagggcctaggatcccaaccacagagccctgcagattctcaaaagcctctcagctagactctgcttaagcctgctgagttcccggtggggaggggcgactagcaccacagttgcggctgcctgttgtttaagccatttgagctctttgggggaggggcagcagccagcactgggactgatagctgcctaacacactaagctccctgggcaggggaagggtggcagccatctctatagctccaggctacacttttcccctgctggagccaggaaggcttggttccgagaggggtcccccgcagcacaacacaccggctgtggcagactgtggccagagtgcctcttcaggcctgacactgacccatccctcctcactgggaggggcctccctgcaggaactccaactccaggcaggggctcaggcacaaagctctgatctccctggccggagccactaggggtaggggtgaccacagtctctgaggaccagcagacttagcctttcctcctgctagttctgagaaatctgggcagcccagatgagtgggtttcccctcagcaaagcactccccctccaccaagggatagtcaaagagcttcattaaacgggtcctgctccctgtaccacccaactaggtgagaccatcaaacaggggttgtcagacatcctatacaggagtgatcatactggcatcagatcggtgctcctcgaggtcagagttcccagaggaaggaggaagcacccatctttgctgttttccagcctccttgagtgactggctccaggcacaggagcgagccagatgaatagtgcctgaagtgaatgcccagcaaaccacaacagccctacagaagaggggcctgaccattgaaagaaaaacaaacagaaagcaacaacaacagcatcagcaaaaagtgtctccccaaaaaaacccatcaaggataggcagcctcaaatatcaaaactagacaaattcatgaagatgagaaaggatcaacaaaaaaaaaaacactgaaagcccaaaaggccagagtgcctcttctcctccaaatgattgcaatgccgctccagcaagggtgcagaactgggcagaggatgagatggacaaattgacagaagtaggcttcagaaggtgggtaatatcaaattctgctagctaaaggatcatgttctaacccaatgcaaagaagctaagaaccttgaaaaaaggttacaggagctgctaactagaataaccagtttagagaggaacataaataacctgatggagctgaaaaacacagcggaagaacttcgtgaagcatacagaagtatcaatagccgaatcaaccaagaggaagaaagtatatctgagtttgaagaccaccttgctgaaataaggcatgcagacaagattagaggaaaaagaatgaaaaggaatgaacaaaacctccaagaaatataggattatgtaaaaagaccgaacctacaattgactggagtacctgaaacagacagagaaaattgaaccaagctgcaaaacacacttcaggatgttatctaggagaatgttgccaacctagcaagataggccaacattaaaattcaggaaatacagtgaacaccactaagatactccatgagacaatcaaccccaagacacataatcattagattctccaaggtcgaaaggaaggaaaaaaatgttaagggcagccagagagaaagaccaggtcacccacaaagggaagcccatcagactaacagcagacctctcagcagaaacggtacaagccagaagagagtgagggccaatattcaacagtcttagaaaaattattttcaactcagaatttcatatccagccaaactaagcttcataagcaaagaagaaataaaatcctttccagacaagcaaatactgagggatttcatcaccaccatgcctgccttacaagagcccctgagggaagcactaaatatgaaaaggaacaactggtaccagccattgcaaagacacatcaaaatataaagaccaatgacactatgaagaaactgcatcaactagtgtgcaaaataccaaggtagtatcatgatgacaggatcaaaatcacatataacaatattaaccttaaatgtaaatgggctaaatgccccagttaaaagacacagactggcaaattggataaagagtcaagacccatcagtgtgctgtatttaggagacccaactcatggtcaaagacatacataggctcaaaatgaagagatggaggcaagtttaccaagcaaatgaaaagcaaaaagaaagcaggggttgcaatcctagtctctgacaaaacagactttaaaccaacaaagataaaaaaagacaagggcattacataatggtaaagggatcaattcaacaagaagagctaactatcctaaatatgtatgcacccaatacaggagcacccaaattcataaaacaagttcttagagacctacaaagagacttagactcccacacaataataaaaagggacttctaacaccctactgtcaatattggacacatcaatgagacagaaaattaacaaggatattcaggacttaaactcagctctggatcaagtggacctaaaagagatctacagaaccctccacaccaaatcaacagaatatacattcttctcagtgcatggcatttattctcaaattgaccacaaaattggaagtaaaacacttctcagtaaatgcaaaataactgaaatcataacagcctctcagaccacagtgcaatcaaattagaactcaggattaagaaactcactcaaaaccacacaattacatggaaattgaacaacctgctcctgaaggactcctgggtaaataatgaaattaaggcagaaatcaagttatttgaaaccaataagaacaaagagacaatgtgccagaatctctgggacacagctaaagcagtgttaagagggtagcactaaatccccatatcagaaagctagaaagatctcaaatcgacaccctaacctcacaattaaaagagctagagaagcaagagcaaactaatccaaaagctagcagaagacaagaaataactaagatcagagcagaactgaaggggatagagacacaaaaaaccctcaaaaaaatcaataaatccagcagctggttttttgaaaaaattaacaaaataggtagactgctagctagactaataaagaagaaaaaagaatcaaatagacacaataaaaaacgataaaggggatattaccacttatcccacagaaatacaaactaccatcagagaatactataaacacctctatgcaaataaactagaaaatctagaagaaatggataaattcctggacacatacatcatcccaaaactaaaccaggaagaagtcgaatccataaatagaccaataacaagttctgaaattgaggcagtaattaatagtctaccaaccaagaaaagcccaggaccagaaggaatcacagccaaattctaccagccaaattctacaaagaggagctggtgccattccttctgaatatgatccaaacagtgaaaagcaggtactcttccctaactaattttatgaggccatcatcatcctgataccaaaactgggcagagacacaacaaaaaaaagaaaatttcaggccaatatccctgatgaatattgatgcaaaaatcctcaataaaatactggcaaaccgaatccagcagcacattggaaaacttatccaccacaatcaagttgacttcatccctgggatgcaaggctagttcaacatacacaaatcaatacatgtactccatcacacagacagaaccaatgacaataaccacacgattatctcaatagatgcagaaaaggcctttgataaaattcaacatgtcttcatattaaaaactctcaataaactagatattgatggaacatatctcaaaataatcagagctatttatgacaaacccacagccaatatcatattgaatgggcaaaagctggaagcattccctttgaaaactggtgcaagacaaggatgccctcactcaccactccctttcaacataatattggaaattctggccagggcaatcaggcaagagaaagaagtaaagcatattcgaatagaaagagaggaagtcatattgtccctttttgcagatgacatgattctacatttagaaaacccagcatctcagccccaaaactccttaaactgataagcaactttggcaaagtctcaagatacaaaatcaatgtgcaaaaatcacaagcattcctatacaccaacaatagacaagcagaggaccaaatcacaaatgaactcccattcacaattgctataaagagaataaaatacctaggaatacagctaacaagggatgtgaaggacctcttcaaggagaactacaaaccactgctcaaggaaatcagagaggacacaaacaaatggaaaaacattccatcctcatggataggaaaaatcaatgttgtgaaaatggccattctgcccaaagtaatttatagattcaatgctattcccatcaagctaccattgacaatcttcacagaattagaaaaaactattttaaatttcatatggaaccaaacaagagcccatatagccaggacaatcctaatcaaaaagaacaaagcaggaggcatcacactacctgacttcaaactatactacaaggctacagtaaccaaaacagcatggtactggtaccaaaacagacatatagaccagtggaacagaacggagaactcagaaataacaccacacatctacaaccatctgatctttgacaaacctgacaaaaacaaacaataggaaaagaatttcctattcaataaaaggtgctgggaaaactggctagccatatgcagaaaactgaaactggaccccttccttataccttttacagaaattaactcattaaagacttaaatgtaaaacccaaaaccataaaaaccctagacgaaaacttaggcaataccattcaggacataggcatgggcaaagacttcatgatgaaaacaccaaaagcaattccaacaaaagccaaaattgacaaatgagatctaattaaagagcttctgcacagcaaaagaaactatcatcagagtgaacaggcaacctacagaatgggagaaagtttttgccatctacccatttgacaaaggtctaatatccagaatctacaaggaacttaaacaaatttacaagaaaaaaaaatccccatcaaaaagcgggcaaaggatatgaacagacacttctcaaaagaaaacatttatgtggccaatgaacacatgaaaaaaagctcaacatcactgatcattagagaaatgcaaatcgaaactacagtgagatactgtctcatgccagtcagaatggtaattattaaaaagtcaagaaacaatagatgcttgggaggctgtggagaaataggaacacttttacactgttggtgggaatgtaaattagtccaaccattgtggacgacagtatggcaattcgtcaaggatctagaaccagaaataccatttgacccagcaaccccattactgggtatatatccaaagaattgttccattataaagacacatgcacacatattatcactgcagcactatttacaacagcaaagacatggaaccaacccaaatgcccatcaatgatagactggataaagaaaatgcggtaaatatacacgatggaatactatgcaaccataaaaagaaatgagaccttgtcctttgcagggacttggatgaagctggaagccatcctaactaactaactaacaggaacagaaaactaacacaggaagagaaaaccaaacaccgcatgttttcactcataagtgggagctaaacaatgagaacacatttagcggacaacagcatagtgtaaatacaacttttatatgcacttggcaatcaaaaaattcatgtgagttgctctactgcagtattcgctttattgcagtggtctataactgaatctgtagtacctccaagatatgcctgtgtaaagcaacatattcacagttctgtgtattacaatatgaacatctctgacatgaaaatatgcataaatttctcacattttataagaagtttttattcatctttctatttgaaagacgctttttccgagtataaaattctagatcaacagctaatttttggcaccttaaagacagtccattgtctttctgggtcacaaagctagtggtaagaagtccaccatcaccctcatctttgttcctctgtaagtaatgaagttttggagtaatgaagtagtttgtaagtaatgaagtcttgaagtttgccattttttttcttctggcaatttaaattttatagttgaggttcttagagtgaacttttcatttcagtaattgtacttttgaactccagaatttctatttgatttttttaatcatttctctctattgatattctctatttgatgcaaaattgttgtcctaccttcctttatttaatcatagtttcctttagttctttgaacatatctacaatggctactttctagtcattttctgttagtctgatttctgaccactgtctgcctactgtacttacaaagtatgggtcatattttcttgtttcttttcacgccttgtaaatttctgttggtaactggacattttaggtaatacatcatggcaactctgggtaaacccacccctgctctaagcttgttattatttgttttttgtttaatgactagctggactattttagtgatgttcactgtcatcctcatctttgattctctgtaagtaatgagtatttttccctttttgcatataagtttgtcactgtatcactagatttcagtaaactgaatatgacacaaatatgactattttccacctgcagtgttaaatctttggtgctgctcctcaaggagttgtagctttgtgcatgtatgctcacatatggtcactagtatgacagtggttttggcaggactctttttgtcactttctctgaccacgtccaactgttaagctatactaagtgccagctgatttatgtactgctttcaacaatactgtggtgcttaaattgttctatagactaatccatcaaattcgggttcctttgaaggagtagttcctacattgtttgagatttgctctgttgaggagctctgaccacagatgggctcccacaagctgtctctttccaagggtctctgcttttccctccaggcaaaatctcaagtcaagtcaagttgagtcaaggctctggaactagggtggcagacaattgcacactctctctaaatgacaccctcactttaagagctgagtgctcattgggggccagagagggtagaagatgaacagtagcctccaacttttttggctagtttcatccagagtacaacactcactttacagactaaggcaaggacaatcagaacccctatatctcagcagtgccaaacccaaggtaaagactgcatctcatgagtggggagctgtgcagaagagaactctacttcagaacttagcctcatcaataggtagctgtggcaagatgagaaaagctgatatccttccataggattactctctgtctgggagctgagaatagagagagccttgtgttttgggctgcactagtttggaataaagtttccatctcactaagctgggaaaggggataggagggaaagggtctcagttccccatagagtcttgctgttcttaccacaatacagattttctggaataaacgtttcttcatctacttattatttaaatgtccgtaagactatttccagagacattaaatggtatgttgttgggtatttttgtttttgtttttgttttgtttcttttgtttgtttgcttgtttttgagatagagtttccctctttttgcctaggctggagtgcaatgttgttatctccgctcactgcaacctccacctcccaggctcaagtgattctcctgcctcagcctccctcccaaatagctgggattacaggaatgcaccaccacacctggctaattttgttttatgtttatttgtttgtttttgagaaaatgtctcactctgtcacccagactggagtgcagtggcacgatctcggctcaccgcaacctccgcctcccaggctcaagcgattctcctgcctcagccttccaagtagctgggattagaagcgcacgccaccacacccagataatttttgtatttttagtagagacggggtttcaccacgttggccaggcttgtctcaaactcctgacctcaaatgatccactcgcctctgcctcccaaagcgctgggattataggcgtgaaccaccgtgccgtgtgtgtgtgtgtgtgtgtgtgtgtgtgtgtgtgtgtgtgtgtgttttaattatcttcaccagtttttctggagaaagagtctgctgagcttctcatgctattatgccagaagtccctcccagtcaattaacaaaagtggcaaggtaattcaatgagaatactagagtctttttcaaaaaatggttctagacaatgaatatgggaaaaatgaaactcaacctttccttataccatatgcaaaataatttggaatgaattacagcctaaaatatgagtcaaactattaaacttctagaagaaaacacaggaagaattatttgtaattttgggataggcaaagatatcttagctaagacacaaaaaacatgaatcatacacacataaaaactgtaaaactgggcttcatcaaaaatttttaaagtttgtcctttaaaagatactgtttgaaaaattaaaaggcaagccaaagactacgagaataactttaaaaccagaaatctgatgaagaacttgtttttgagatatataaagaattcgttcaactgaataataatatagacaatccaatttaaaaatgggcaaaagtttgaacagatacttcatcaaagaagatatgaaaaatggcaggtaaataaatgatgttctataatattggtagtctttaaggaaatgcaaattaaaaacataggattgcactatttacctattaaaatggctaaaacttaaaagactgatgatatatatagcaagggtacagagcaactgtaatacttatacattactgattggaacttaatacggtacagccactttggaaagcagtttggcaatttctccaaaagttaaacacagacataacatacagtgcagtaatcccactcttacatgtttacccaagagaaataaaaacacaaagacttacatgcaaagattcataactttattaattacagccaaaatctggaaacaacccaaaagtctatcaacaggcaaatggaaaaacatgttgtagtatagccttacaataaaatactactcagcaacaaaaggaatgaaaatatcagtgaaagaagccaggcacaaaagactgtatgattctatttgtatgaaattctagaaaaaaaaattatagtgatagaaaacaaatgtgtggttgcctcagggtgggactgttgtgtggaaattggccaaaggggcatgagagatctttggaagaatgatgaaaatattttatatctttattatggttttagttacattactatacatttttcaaactcacccaaatgaatcctgaatgaattttattgtatgtaaattatatctctaatttttttaaaaaggtcaatagaagcaatgtattaaatagtttaatagtagagaaagatcagaaagatcaagacagagacactgtcttcatgtatattaacgtactggatatcagagattctgaaattatgttagatatcaagtgaaaatattcttttgtcaatcattttcattcagttataagaccaacatttatcttaagccagatttgtgaaaattcaatgtaaaaataattatcatactatttcacaagagtgttattgttccttgctcattaaaaaaaaaaagagcaagagcttgttgagatgtcatagctaacaaagctataataaactgggatttttttcagcaaatgtttgcttccctttcctctttgggtcagggtatactttccactcccactgcctttatgcttggccatgcgacttgccttggccaatggaatatgagcatgcaggatatctgcagaattttaaatgtgtttgcctggcttagcttgcacttgaactcctataatcaacatacaattacaacataggcaaccagtgcctcgttaggctggatcaaagcgtgaagcttaaggggcaaacctgaacttacctcaaagcctgaaactgaactacagcataaagcagagccacttatgagtgagaaaattaaaagcttgccatgatacgacaataaatttggtggaggtttgttacagcattattatggcaagagttgactcatgcaaagctaacatttgaggagaaattacaatgttctaggcactgagctacaaactttacatatattacccatttaattatcacaatgactctgtaagagaaaacattttacattgtctttctaaaatacatgatgaaactgaagcacaaataggataattgcattatccaaagtctcagagctagtaagtaaccaagtagggtttaaacccaggatgttataattctaatactcacccaatgcactaattatcaagatcaaattgaatttttaaattctattcttctagttggggtgttaaataatggttaacactcttcaatctccataaacccttttcttctcttccacctaacctgcccatcttcatacctgtatctaaacaaccatctgtttactgtaccccaactattgggttgtcagtagctagaaaagtacgctgccttgactccattacaaggttagctgatggactttccatatagctttgcaaaattgtgcttattcatgttgattccattttgcattccccacaatagctgttccaaaccttaatcaccaagataagccctaatttcaatatcactcctcactctcagaggctctgcctccaatttctcagcgaatgaatattccatgaggcattacatttctcaacttttttcctctctgccttatacctatctttacctctctttactccttgctcttgtgtctcaaatgactaattctacccccatattcttgtctttcttccttcccataccttgttctacagatttaacatcttcctttttttctctctactagaaaacctacatactcatttctcccacatctttttttgctcttgttgcccaggctggagtgcaatggcatgatctcagctcactgcaatctccacctcccgggttcaagcaactctcctgcctcagcacccccgagtagctgggattacaggcatgcgccaccacgcatggctaatttttgtatttttagtagaaatggggtttcatcatgttggtcaggctggtctcaaacacctgatctcaggtgatccgcccgcctcagcctcccaaagtgctgggattacaagcatgagccaccatgcccagccctatttctcccacatcttaagccaactttcccacaaacctgatgcctccacaaaccaccaactcatctttctccctgctttcactgttaaacttcttgacaaagtaggtgctgtatcagctatctttactttttcacctccaagtcactccttaatacattacaggataagttccccttctgtgaactttaccaaaattattctctcaaaggacactgacagtttccaaattgcccaagtcagtgatctcctctcagttatcatcttaaccaagcctttctctagttttaaatgacactgttgactacatacatcaactccatccctccagacccaccctgcacctcattgttcctccttctatgttctctattatggttactggtaccattcagtcacccagcctagaagtcttaaggtcaatctagtctttttctctctcacatcatagcctcttaacatctccaatattatttttattactattttgctcttataatctctcagttggactattcaaaaagtcttctaagatggaagttgatagcaataaacacctacatcaagaaacgtagaaagatttcaaataatcagtctaatgatgcacctaaaggaattagaaaagcaagaataagccaaatcccaaagttagcagaaggaaagaagtaataaaaatcagagcagaaataaatgaaatagagaccacaaaaataaaaaagatcaacgaaatgaaaagttggcttttcaaaaagataaaattggtaaaccactagctagactaaccaagaaaaaaagagaagtccaaataaataaaatcagaaattaagaaatggaacatcacaaccaataccttagaaatacaaaatatcatcagagactattattaacagctatacataaacaaactggaaaacccagaggaagtggataaattcctggacatatacagcctaccaagaataaatcaggaagatacagaaaacctgaacagaccaataataagtaatgaaactgaatctgtaataaaaagcctcccaacaaggaaaggcttggaccagatggcttcactgccaaattctaccaaacatataaagaagaactagtactaattctcctcaaactattccaaaaaaataaagaggagggagttctccctaactcattctatgaggctagaattaccctgatactaaagccagacaaggacatataccaaaaaaaaaaaaaaaaagaatatccctgaaggacatagacacaagaatcttcaacaaaatactagcaaactgaatatcatagcacatcaaaaagataacacatacaccatgatctagttgcatttatcccaggttgcaaggatgtttcaacatatgcatatgaataaacataatatatcacatcaacagaatgaaggacaaaaatgatatgatcattgatagatacagaaaaagcatttgataaaattcaacaatgcttcatgataaaaattctcaacaagctagcatagaaggtagatatctcagcataataaaggccatatatgataaacccacagctaacatcatactgatggggaaagcatttcctctaagaactagaacaagacaaagatttccactttcaacactctatgcaacatagtactggaagtcctagccagagcaatcgggcaagagaatgaaagaaaaggcgtccaaactggaaaagaagtaaaattgtccctctttgcagacaatttgatcttatatttagaaaaatcaaaagaaaccaccacaaaaaaaaactcttcaaactgataaattcagtaaagttgcaggacgcaaaatcagcacacaaaaatcaccagtatttttatacaccaaaaatgacatagctgaaaaagaaaccaagaaggcaatcttatttacagtagctacaaaccaaataactaaaaataaatttaaccaaggaggtgaaagacatctagaaggaaaactacaaaacactgataaaagaaactgaagagggcataaacaaagagaaagacatcccatgttcacagatcagaggaattttatggcaaagaattcaaaagcacagacaacaaaaacaaaaatagacaaatggaattacattaaactaaaaagcttctgcacagcaaaggaaacaatcaacagagtggagagacaacctattgaatgaaagaaagtatttgcaaactattcatccaacaagggactaatatccagcatataaggaactcaaatgattcaacaataaaaaatctaataatcccattaaaaataggcaaaggaaatgaatagacacttctcacaagaagacatacaaatggccaccagggatatggaaaatgtcaacatcactaatcatcagggaaatgtatattaaaaccacaatgagatatcatcttaccccagttagaatgactattattaaaaagacaacagatgctggtgagaatgcagagaaagggaacttttatatgctgttgataaaaatgtaaattagtacagctgctatggaaaacagtatggagatttttcaaaaaactaaaaatagaactaccatgagattcagcaatcacactgctggttatttatcatcaaaggaaggaaaatcagtatatcaaagggatacctgcaccttcgtgtttattacagcactattcacaacagcaaagacatggaatcaacttaagtgcccatcaacggatgaatggataaagaaaatgtggtatatatacacagtgaaatacttgttgtccataaacaatgagatcctgtcatttgcagtaacatggatggaactagaaatccttatgttaagtgaaataagctagacatacaaagacaaacataatatcacattttctcactcatatgtaggaggtaggaaatgcaaacttaatcaagtaatggctttcctctccttcccacttcttttccccatgcttaaaacccttcagtgggtattccataattatccattgcctagaggataaggacaaaatgtattattgggaataaaaggtgttttttggccacctctacagcatcaactcctgatcacctccccataccatgtcttttgcatccttgaaatttttccaccttgttcccttcaacatcactttttcctatttcccccctacctgtataatacctttcagtttctttctcaagttcttagatcctcgggtctttgttttttcttctcttttagttctagcaattcaattgccctgggcaatcttgtcccttctgatcaacctcattgtgtccaattaccaactattcatcaatagtttattaattttaatctacagcctccaacttctatcctaagccatagtcccatagacattctagtattgtcaataattacagctcatttattgaaaaactgctacatgccagcaattgcattagatgtgtgctagaacacatatctattaaataaacatgttctcatttaatcattacagaatgctgtaaagcaggcacaactgttccttctttgggatgaacacagacatggaatttatataatgttcccagtatcatataggtagaaagtactgaagcaggaatttaagctcagattggcaaaagaccatttcactaagatattcactactttttaccaaactccttcaaatgcacatattcttcagtacttattttattatttccaaacccaaatcactcctccatctgttattcccacattcactcatagcattactattaccaggaacaatacagaagtcttccaagtcacatttaactcctccatctaacttctccatatttgttgggtcactaagccacattctatgtctgaaaaagctcttgaatctccctctttttattgtagtatttcagtagctgtctcacagttctccagtttctgcccctgtaattatcttccatttctttgagagtttgctttctaaataaatctgactgacttctagataagatgactgaatatgcacaattctcttctctacttcctaatattccaattaaaatgatcagtgaaaccattaaaaactagagtaaccagtactacaaagaataacattctcacatcacagaattgaagaacttttgtaagtttaggccaacagaactttattgaaggaaggattggcccaaaccaagactcactagttaagaagtaacttgtctggaaagtaaataaagaaaaccaacagaatcccacaaatatgctcacatttggagatgtgaggctggaggtgaaagcagactgtgaagcaagtaggtgattccatattatattgtggcttagagttcaggtggacatttgataccaactcactgtgtcctttaagctgtaagggcatatactaatactaagtactctgtggaatattaagtcctctagtggaaggccatcttccactagacttaggcaaaggttaggaattacttccctcactccattcagggagggtattcacatacactatcatctttctccaaaatctctcccctaatctcccatctcctaactttcacaacctccatgtctttaagggatgcaaatgctgtctgactaattctaccctaactttataaattctaaaccactgtggccttcaaccccactttgaagtatggcatctagtatcttggggcttcaaaagaaacttccattttaatatccttttacattaatactctggataatgtttctatctgtgatttgatggggagggttttttttggggggggcggggccaaaaaaaaagtactcaaagctaaaaaaaaactccatccaagatcctttgtctttaaataccatttgaagttagactagtggattcaaatcctgactccagggactaactgtataagctttgggaacaatctaagcatcttaagtttcagttttataatcatatatgaataatgacaggccttcgtagaattttgtaaaaattaaataacatgttctaaacaaaactaaaaatatttctagcggcccataatgtcccagatgaaaactgccccttccacgtctctttgaccatgtcatctccatgtcatctctatgtcatctccgcctcactcatgccaatcactgttccacctcaagcgttctgctgccacttcttttttctccccctggaatattcattcctcagatagttgatggctaactgttccacctgcttcaggtctttgctcaaacacaaccttctccatccttctctgagcattccatgtaagcctaagccccttgttttacttctgcccttccctctatcccttccctgccttgatttgctccatagcacttatcatctttatcatactacatattttcacatttttactttaccttctgtctcctcccacttaatgtgggatccactaagaacattacctggcacataagaactagtcggtagccaggaacagtggctcacacctgcaatccagcacttttggagacagaggcaagagaatcacttgagcccaagtgttcaagaccagcctgggtaacacagtgagaccccatctctacgaaaaaagaaattaattagctggccatggtggcacacacttacaattccagctacttgggaagctgagggggaggatcacttgagcccaggaagttgaaactagagtgatccatgatcacacaactgtactccagcctggttaacagagggagaccgtgtctcaaaaacaaaaacaaaaacaaaaaacaaaaaacaaaaaaactagtcaataaatacaggctactgttgtaataataaatattataatgcagcacctctgtgaaatattccaggaatcagacctgactgcagcattgttcctggcttacacacagcatgtcaggcaaaagtgtatgtcagacaagaaaaaggatctgctcatatgaaagcatagggtaaaatcacaaggatcaatgagggtaagttaaatagtatcccataacatcaagttaaattaaaaattaggagaaatggggccagcaagatggccaaataggaacagctccagtctgcagctcccagtgagatcaatgcagaaggcgggtgatttctgcatttccaacccaggtacctggcttatctcactggaaatggttagacagagggtgcagcccatggagggcaagctgaagctgggtggggcatcccctcacccgggaagtgcaaggggttgggaaattccttcccctagccaagagaagccgtgagggactatgccatgaggaacagtgcactccggcccagatactacacttttcccactgtttttacaacccacagaccaggagattccctctagtgcctatgccaccagggccctgggtttcaagcacaaaagtaggtggcaatttgggcagacacctaactaggtcaggagatcgagaccaatctggcaaaatggtgaaatgccatttctactgaaaatacaaaaattagctgggtgtggtggcgcgtacatgtaatcccagctactcgggaggctgaggcaggagaatcacttgaaccaggcagtctgaggttgcagtgagccaagatcacaccacagcactccagcctggcaacagagctaggctccgtcaaacacacacacacacacacacacacacacacacacacacatcaggaaacaacagatgctggagaggatatggagaaataggaaagctttacactgttgatgggagttcgaccattgtggaagacagtgtggcaattcctcaaggatctagaactagaaataccatttgacccagcaatcccattactgggtatatacccaaaggattataaatcatgctactataaagacacattcacatgtatgtttactgcagcattattcacaatagcaaagacttggaaccaacccaaatgcccatcaatgataggctggataaagaaaatgtggcacatatataccatggaatactatgcggccataaaaaaggatgagttcatgtcctttgcagcgacatggatgaagctggaaaccatcattctcagcaaactaacacaggaacagaaaaccaaacaccgcatgttctcactcataagtggaagttgaacaatgagaacatatggacacagggaggggaacatcacacactggggcctgtcgaggtggggggcaaggggagggatagcattaggagaaatacctaatgtagatgagagattgatgggtgcagcaaactaccatgacacaggtatacccatgtaacaaacctgcacattctgcacgtttcccagaacttaaagtataatgaaaataaataaataaataaagctaaatttaaaaaaaagaataagatcatgtcctttgcagggatatggatggacctagaggccattatccttagcaaagtaacacaggaagagaaaaccaaataccatatgttctcacttataagtgggaactaagtgatgagaacacatggacacatacagcggaacaatacacactggagcctattggagggtggaaggtggtaggaaggagaggatcaggaaaaaaaaaactaatgggtactaagcttaatacctcggtgataaaataatatgtacaaacccccatgacataagtttagctatgtaacaaacctgcacatgtacccctgaacttaaaagaaaaaaaaaaacagtggaggcaattgcaaagacaataaatgatgtatttgattacattaaaaattgaaatatcaaaacattcccagaaaaattaaaaagaaagaaaaccaaagcagagtattcacacacaaaaaatataattttttaaaaaatctagattttataatttgacttaagaaacaacataacaaagactggtatggaagatgcaaaatttttaaatctaagtatgtcactgtttattaaagtagtaaaaataagagtaagtgaaatatacattaaaatgcacactagaatttggctgggtgcagtgaatcacgcctgtaatcccagcactttgggaggccaaggcaggcagatcatgaggtcaggagttcgagaccagcctgaccaacacggtgaaaccccgtctctactaaaaatacaaaaaaaaaattagccaggcgtggtggtgcacaactgtaatcccagctactcaggaggctgaggcaggagaatctcttgaacccgggaggcagaggttgcagtgagccaagatcgcaccactgccatccagcctgggtgacagagggagactctgtctcaaaaaaaaaaaaaaaaaaaatgcacactagaatttaagtttttattctctggttgcttttatttcaattactaatgttagaagctattttttagcaaatcctcacaactttgtacttttccaggcaatggccatcaatatcttcctttctctaaactggccaagaaatcttgataacaaattattttgacctcatgatattatatcagctacctctaagtgctttctctagtttatagcctagcaggcagaaactctgccttaattattcacatagtatctgatttaagtaacctattatatgcatatacttaattataataaattgtatcagggtctctcaacaaaatgaacttctattattgtaagcctacagatatagggaaagacttttgtctcaagcacgacaaaatctagaggttcacctaaaatagagattaaagaaaaagacctttcagttcctatggctattgtttcattaattttagcatacatgtaatttaccaataatctaatgtagtctattttttaaatgatttttaagtataactttgtctccattatgaatatatttttacaagttacttctaaaactaagtctatttctaaaaccacattttggaatggcaagtcatcttttctctcagaatgaaatctacaacataacgttaatcttttaaggatagagaggaagagaggattaataaagcaaatcttattccagtacaaataggaatctgtatgtggctggagaggtacctttatgctgaataattttcaagttatatgtaactttattctgcggttttctattcctgtgggactgtgagagcaggtgaaatatttgtcaccaaccataaaaaattatgaactaaagtaataacactacaataactaagctcgtctctaacagatgtattctgtggaaatttcccaagacaacagccttagaaaatggagtagtgttaatttcaactaaagttctccatattgaactatgtcttacaggtctaaagttctgatgcatctttaaataatgggttttgaaaaaagcttcatacatcttgataactttctcggctttaattgtgttgattctaacaatcctaatgagaaaaattaatgcctaaagccaatggtgataccagaaagatattaaaatacagctggcactctttatccatgggttccacgtctgcagacaagaagggtcaactaaggaacttgagcatccatggatttcagtatcctttgggttcctgcaaccaaccccctgcagatactgaaagatgactatatctggaacatacagattaaatgagatattgggaataacaaaagagggagaaatgaaggggaaaggtttcaagtgaattaattcttacttaaaaaattcatactaatagattaatttctcctttttgagagtcaatcacatgataagtcaatgtaatatttttcaatatacactaaatagtatagaatttggtgaggcacaaattccctgaactggatcaacagaagtttcttatttaaagtacaagaccatcattaaaagtttcacttacaactgtaaaccccaagaaagaacagatgctctgaagcattcttcacactgtccttaagtccctatgtccacctcttcctctgcattcagattaacttctgaaggaaatcctgaaatcaagcaaatataacactacagctacaggcattctttttttactctgcttagttcctctttcttcagtactaaaattaaagctatacaactgccttagcagcctgaataaatgttctatctttgaaggattagaaacctgcaaatggaaaaggcgttacaaacaaaacagtaacttaaaaagatacttcaggccaggtgcggtggctcatgcctgtaatcccagcactttgggaggctgaggcaggcagatcacctgaggtcagaagtttgagactagcctgactaacatggtgaaaccctgtctctattaaaaatacaaaaattagctgggcgtggtggcacatgcctgtaatcccagctactcaggaggctgaggcaggagaattgcttgaacccgggagatggaggttgcagtgagccaagattgcgccactgcactccagcctaggtgacagagtgagactctgtctcaaaaaaaaaaaaaaaaaaaaaaaaaatcagtagtatctttaggagcccaagaagccatcctaacgaaaaaaacacaaatgcttattaaggggatcctgatgaaaagactcaggatgttcaaagtcttaaatttgttttaaaaaccttcaaagtataaatagctattctaatatctaattcaataaacaaagagaataaggaaacataacataactgatcactgtaattgtgcataagtgcacatgcataaagaaccaatgattaaagacagaagtaacagtgatgttaagaaacattgatgttgcaacataacaaactaatgagaagcataagaacagtaaacattgggcaaatttgtctcaagctcatcttcatcagatttcagcttacagtatcctatctactcggaagtccttaatagtatataaaaatatctctaagcacttcaaaaaacaacattaagaagagcaaaatatggtggttttattcatgtggcttctcatttattgaaaattcagggtctccatgcttgcaatttgcaaacaactacaaacagcagcctcaattttctatcttatcacttgggaaaaagcactaaaatcatttttaatggtttattttgtaagcacaaattgtaagcatcagattgtgaaagtatcttgatgctataaacaaacagtaaaattacaatttacaatttaattaagaaaacaaaaaatataacctgtcattttattatttttaaaaatctaattgatttaaattaaatgccatgtttcatttgtcatataagaaaatataaattcacctttcatattaataattatacttcaattatattttatgatacaatatttaactactgatctaaaatatatattttcttatttttaaaatacattccataaataaaagacaatgattttctaaatatttaatggtgttcaaaaaaacagaaagaaccacattaataggagttcatgagccatatacggttggaaaaatatgctcttagataagcctgattattcccactctaccagtaataacaaaaagactcagttatgtaagtaatttgtgtccaagtttacataactggtgagcagcaacactagggtttaaaccagggccgtgtaactctcagcttattctatgaaatcatgatatcaatgaacaaatgaatgaattttatttccccaaggtttctgaataagaagctatttccacacactgttaggtggcttcattgtgccatcaataataacacagatacaattaaggaaataattcagtgtaacaaatattttctctagtccctatccaagtgtttagtactcaaaaatgaaatgctcatgtattagcaatctggctatcaaccaattcaaattaaaattccatttaccaatgtcatcaattacttcctaatgtcaactcttttgcagttttcattgcttgtggcctcagcagtcagtcattttccctcaaatattctcatttagttcctgttatgttacattaccctgaattttttctacctcttcattcccttgcttctatacaatcattgtaatgacataagtacaaatattaacaaaagtatatcagtgcaacaaaaaatatgacagagtaagtaacattaactaggacagagagaggtataaacttctagatcccaaaattctcactaagggatggatggctgtaaatgactgtattggaaagtcacatcagttcagacctcaggaggcagtattgtcccatctgggcatagtcttacatacagaagcaatccagcctgcatctgagacaggtgtatttttttctaacttcaagttgtataacatgtaacatgactgcaagagtactatacataacacattcaagcagttttttaaatccttaatcctcaccctcagactctctctagtctgataaagcctagtccctataaattactaaattcagtgtcatggaactggaactacaaatccctgggagtcatgctatataatctattctaatttctttcatataccccatattccctatattcttcacactcccaaaaatgggacccttcaaaggctcaggtctgaacccctttctcctccttcaatatatcaagcttatacctttgtgtttataattccacaatcaaatctcttgccctaaaagctttcccaagctcctttttcaaacctccccctgctaggcatcaccaccttggaattttgcagtcacctcaaggttaacatgtttgaaactaaacttatcctctttctaacacagccagtttcccttcttgttttctgagttgcagaagagagtgatccctggtttcctctcttctccctctctcctgcaacctatagccaccaagtcttgtaaattcagccttcataagtttccttcctgaccaccccaatcctcatctcagccctttttcccagagaaatgcaactgtttcctaactgatttctacacaaactgtctcttcctctccctctgctcaaactatatttcacacttcacttcctgttaaaaaatctttaatggatccccattgcctataaaatatctttcatactatttatccaattatttaaaattcttgttggatccctgtctctataacctcttctctctcttctcctatacatcagtcatccaatccagtcaaattgctccaaataaaacatgcagtcccacttacgtgatgttggttggaaatttctcacgcctagaatgctctcctttctctcctacacttaactaagccctacctttcaaaattggattgctatctcaaatctctcttattaaacacatgtgaaaaatgaaccattttctcataatccttgccaaaaaacaacatctaaactcctaaagaatccatccaaaagaaacacatgagtacacctaaaatctgaaagtcaggagaagaagaataatgtatgaatgcaaatttctttttccttctatattgaagcacttttggcctcatgtgttcactttctattcttaaaggtagagacttaattctattttctacagctcttaaaggctgataatgcagttattatgattgcgactagctagctcatcttgttagagaaagtatcatggtactgggttaagtttaaatatccatatggaatagaaaacttcatttatttgggtgccacaaattgcaaccctgacccttcccagaagtctattaatatctaccatgaacaccaagataatgtttgtggccagatgaaagtaaaaacagcctaaagtgaacacccaactgattttatttccttaaaatggatttgaaatagaatattttattattagttactttgaatattattgatatttacaaaaacatacttcaagtaaatctgcctaaaattggcttgagaactatctgaagagatttttttttttagattttcagaaaaatattcctcatggaatatctttccaattttgcagcataaaaaaatagaaaacattattttgtttcttatcaaactaatttttcaattttcattcatttaacaaataatactgagtatatacttatgccagaatttttctagacaccagtaatacagcaataaactaagtagataaagctgctgctctcaagtttacattctagtggaaggagatagaaaataaacaagcaaatatataatacgttgaatcgtggtaagttctctgaagaaagataaaacagggtaatggaaatagagaacactaagaaggaaaacagagaagactttattgacaaggtgatatctggacagatattttaaggattatagctattcataaaatatggaataccagcatagccaaaattcaggtaatactgtgatgtagtaacctaatgtttcctagttacattacttaaatattctgtcctactgaattaacaaatcctgggagtaaaatatttgtaaaagcctaggctgcaaccaccctcaatcatctgatatagacactatagttttctaagctccctccatcagcaaaatattcgttactcaaagctgatttgtactgaccctgtgggacacaagcccatttcaaggctgctggctatagcttgaaaagaaccactgagatgtaactgaacatttctgttcaagtagggctggccctacccctacctcctataagctttgacctggatacataatccggggctaattaatcaatacatccatctctttgacaactgagattggctcagcagtcaaaatgtgatcaaacttagaaatcttgcttgaatttggggaaagaagcgcttttggccaggattattaagcaaagaacacaatgaaccttgggctacttatatcccttgccaccatatgggaaaagctggcctgagaacaaaaccagtgtagaggaaaatccagctgaccaatggggaaaggcagattccagattacattgtttgagtactaggatccataaaagcctagatttttcatttatatgcgctaacacattccttttctgcataaatcagtttgaattggttttgaagagatacatggaaaatcagaaaataagatatggcagaaattttctcttcccattttcaacactgaactggtatattctaaatatggatatatgggtgttacctctttgatggaagtaaacaaggttttatcaccggacctaaagtctgaacacaaggccatttcaaaggaataaaatctaattttccttaagggagtcaatataaacaaaagaaggtccagggctatattggtgaccatcagaagctagtgcttcagaaagagtgtctcagggtttaaagattctggcatatgaaaaatattactttgagggaaaatccagtacacaaaataaaaggaattctaaagcaaatcaaatgaaagcaaatatagttcactgtcagaaaagataaagaaaaaaacgaaaaatagtacaaccagatatatagttgtataatccaagttttagctaggattcttaaaagtaattgctgacttgtccaccagacagtacaaataatcaataacattctatctcacagttgaattttgtaatcacaaaaagaacaagatctcaaattctctctcaagcatattagaattactgattttatttctttaaatatgtaaatttgtgagtgaggcacttataatttataactttttatgtgagtgaatgcatcaaaaattatgtgtaagtgttcaagataaccactctaaacagaagtaaaagacccgctatatatataataagcaaatgcttagaggtcactataatattcctaggaaaaaagtaaaacttgaaattgcattgcataaaggtctaattgttgctatataaacatatttcacaattttacctaggaagattttaattaataaattcatgtttatactactacctataactataggaaaagcttgtataaatgagaactacaaaaatcaacatgtatatggagaaaaattatttaaattataaaagatattgtatagccaattctacttagctttttaacaaacctgttttctctacttcttgggcacttagctaaaccatatttcctagtcttgcagtttgggacagccatgtgattgtatgactgagtactagtcagtggaagataagtggaaatgatgtctactgtttccaggcccatcccctttaacctcctacctcacctgtatcttccatcatctttacccataccaccttttgacagataagccaagtgaccttgaaaggttgtgctcaaaagggcagagtcaatagatgggagaaatctgaactccccctttgaggagagccacctgctgatccagaatacctgttttagactttaaattgttaagaaataaacttccattatatttgattcattatataatttttattttttaaaatagctagtattaccttaactaatatagcttatgattatatcactaatatgtgatcattgatattcatgattcattttatttttccactaattttaagtttttaatatccctagaactcagtacaaatgcattaacttcaaattataaaatattttaatattcataagtagtctacatcttcagtaaaactattttttgaaatttatttctttgcttaatcccagattctaaactttctttaacatttaattaacataattaaacttattcatggctttagtaatcaattagatctttctttaaaaagatttaattggccaaaagatttaattgtaattcttttttgaaatcaggataatgtaacctcttattaaaataaacaaaaaataaataaaaatcagtatgatacatcagttttgccatattcctataaagcatctcgaaagtaacaaaatgcttcaagaaaactaccataaaataacattaaaatatttaaaagaagaatggtcccgccagcatagctcttattcagtaagaatgaatgtgcagtccttctgaagaaacagatgaaaacaaaaaagaactaccccaggcaagactgaactaaaaatttttctcaatttccagtcaaactgtgttcacttttctaacatctacccatccacccacccattcattcttcttttgttcattgattcaaaaattgcatattggtattatgtggcaggccccataccaggattctgtgatatcacaaagatgaaatatatagataatgccctcaaggggttcacagtctaatatattcaagaacaagaaacaatcagaatttataactacttactacaattacaaccaccataagtactattacaggacattgggactctatattataaaaggcactgggagaaagcctaatacaaattggaatgaaggttcaaaaatgagctaagattagaagtaatgttttgatggaggaggaaaagtaaaaataatgaaattggtttggggcagaggagagtgtgagaactcaggtatagttatacatgctgaaagactggtgaaagagagtttggtaaatttatagaattataaataatggggaaaatgatgagagatgacaacacagccctaaataggagcaagttcatgacatgccttcattttccctattccataatcagatgattgttattatcacactttttcctgtgcctttcacctcatattcaaacaggacagaatcacttttcattttcactgattaaaatatagctatttctttttttaacacacttttataagagagctactatctgtcaggcaacatcccagactctcagatatactgttcttcctaactttctacaacaccttatactatcatttactggactgcttgcttggtaatacactttaccaccctgtatttcaattatttggtaatatatctgttttacctgccaaactccaagctccataaaacatggaaatgcctcagtcgttttttttgtctgccataaaacagtagctagtacgtaatataggtataacgaatgtttactgagtggatgaactaaagcaatgaagaaaaatggattagctttaaaataagagactatcattttagttttctcattacgcaataagattttttaaatatacaaaatatcataatgtgtattttatgtttatatttttatgttttgtaggatattgatactatttattggtaagtaataatattttattattgcagtaccccttcacaatatacccttatatatacaacttataattctgatagtttctgaaaacacattactattggaatgctgctaaaaatatgactagaattcattttttcatccatataaaaatgtttattgagtagttactatttgtaggacactatgtgaattgcttagcttttatatttcattgccattaaatacaataatgtaagaggtaaaatatgtcaaattaacttccctttgtacttagtcatagtcataccctgaggcaaaggaacaatgtcattcaacctcctttcataaataatatactttgaaacaatgactgattcattgttaaactgcatgattatatagtataaagattataaattcagttgaagttcaggtgttttttattatgagatactgtacttttaaattctggaatttccaattaatgtttttaatagatctcatttctcttctgagagtctccatctgttcaaagaaaaagaaaaagtctgagctggagtaagtaaggaggtttctatataaagaaagacttgaactacacctcataagatgaacaagatttaaacaaacagcaaagatgagagaatgaaacaatgagcaaacacaccatgcaagaaatgcctatgatatttttagacaaataacaaaggaataagctatactggtggcaggaaggagaacagaaagaaatatcattggataaggaggggtagtaacagaatcggaagatcttgacattcttgaactccaagaagaggaaggggccacgataatttagttaaaataaggctcaatattgtatcactgctctgtatacttcaatgtgtttttgtagtggctggtaacagtctttccttttcatatttagtgcttccttcagaagctcttgtaaggcaggtctggtggtaacaaactccctcagcatttgcttgtctgaaaaggatcttatttctcttttgcctatgaggacagagtcaaatctacacatatcaataccagccttaaatgtaaataagctaaataccacaattaaaagacacaaagtagggtgggcacggtggctcacacctgtaatactagcactttgggaggccaaggtgggtggatcacctgaggtcaggagttcgagatcaacctggccaacatagtgaaaccccatctcttctaaaaatacaaaaaatcagccgggcatggtgctgggcacctgtaatcccagcaactcaggaggttgaggcaggagaattgattgaacccaggaggcagaggttacagtgagccaagatcacaccattgcactccagcctgggcaacaagagcaaaactccatctcaaaaataaaataaaataaaataaaagacacaaagtggcaagctagataaagaaccaagatccattggtatgctgtttgcaagagactcatctcacatgtaatgacacacataggctcaaaataaagggacagagaaaaatctaccatgctaatggaaaacaaaccaaaaaaagcaagggttgctattcttatttcagacaaaacagactttaaactaacaaagatcaaaaaagacaaaagagggcattacataatcataaagggttcaattaagaagatctaactatcctaaatatatatgcacccaacacaggaggaagcagattcttaaatcaagttcttagagactttcaaaaagacttagacttccagagaataacagtgggaaactttaatactccactgacaatatgagaaagatcactgagacagtaaattaacaaaggtattcaggacctgaactcagcaatggatcacatgaacccagcagatatttacagaactctcccccagaatatacattcttctcattgccacatggcacatactctaaaattgatcacataatttaaagtaaaacacaccttggcaaatgcaaaagaactgaaaatcataacaaacagtctctcagaccacagtgcaattaaattggaaatcaagactaagaaattcactcaaagccatacaactacatgcaaactgaataacctgctcctgaatgacttttgtgtaaataatgaaattaaggcagcaatcaataagttatttggaattaatgagaacaaagatacaacataccagaatctctgggacacagctcaggcactgttaagaaggaaatttatagcactaaatgcccacgtcaaaaagttagaaagagctcaagttaacaacctaacatcacaactaaaagaactatacaaccaagagcaaacaaatcccaaagctagtagagtacaaaacataaccaaaatcagagctgaatttaaggagattgagacacgacaaaaaaaatccaaaagattaacaaatccaggagctgctttttaaaaaaaaaaattaataacatagaacaaatagctaagctaataaagaagaaaagagggaagattcaaataaacacaatcagaaataacaatggggatattaccccgaccccatagaaatgcaaacaaccatcaaagaatattatgaacacctctatgcacataaactagaaaatctagaagaaatgaataaattcctggacacatataccctcccaagactgaaccaggaagaaattgattctctgagcaaaccaaacctctgaaattgaagcaataataaacagcctaccaaccagaaaaagcccaggaccagaaagattcacgactaaattctaccagatgtacaaagaagaaccagtaccattcctactgaaactattccaaaaaattgaaaaggagggactcctccctaactcattctatgaggccaacatcatcctgataccaaaacctggcaaagataccacaaaaaaagaaaaattcacaccaatatccttcaggaaaatggatgcaaaaatcctcaaaaaaaaaaaaaaaaaaactgacaagctgaatctggcagcaaatgaaaaaccctatccaccataatcaagcaggctctatccctgagatccaaggctggttcaacatacacaagtcaataaatgtgattcatcacattaacagaactaaagacaaaaatcacataattatcacaatagatgcagaaaaggcttttgataaaattcaacatccattcatgttaaaaactctcaataaacagactttaaaccaacaaagatcaaagaagggcattacataatggtaaagggatcatacctcaaaataataaggacataccttataatgtccttattttgaggacatacctcaaaataataagagccatatatgacaaacccacagccaacatcatactgaacgagcaaaagctgggggtgttcccactgaaaactggaacaagacaaggaagccctctctcaccacttctattcaacatagtactgaaagtcctggccagggcaaccaggcaagagaaggaaataaagagcatttgaataggaagagaggaagtaaaaccatccctgtttgcagatgacatgatccatatctagaaaaccacatagtcttagcccaaaagcttcttaagctgataaacaacttcagcaaagtctcaagatacaaaaccaatgtgcaaaaataactagcattcctacaacaggcaagtggagagtcaaatcaggaacatactcccattcacaatagccacaaaaagaataaaattcctaggaatacagctaactagggaggtaaaagatttctacaagaactacaaaacactgcacaaagaaatcagagatgacacaaacaaaaataaattccatgctaatggataggaagaatcaatatcgtgaaaatggtcacactgcccaaatcaatttagattcaatactattcctattaaactaacattgagactcttcaagaactagaaaaaaactactttaaaatgaatatggaaccaaaaaagaaccaaaatatccaaggcaattctaagcaaaaagaacaaagctggaggcatcatgctacccaatttcaaactatactatggggctacagcaaccaaaacagcatagtactggtacagaaacagatacacagaccaatggaacagtatagagaattcagaaataagaccacacaccagaaataagaccacacacctacaactatgtgatctttgacaaacctgacaaaaaacaagcaatggggaaaggattccctattcaataaatggtgcttgaataactggctagcaatatgcagaaaactgaaactgtaccccttcctcataccatatacaaaaattaactcaagatggattaaagacttaaatgtaatacccaaaactataaaaaaaatcctggaagacaacctaagtaataccattcaggacacaggaatgggcaaagatttcatgacaaagatgccaaaagcaactacaacaaaagcaaaaattgacaaatgggatctaattaaactaaagacttctgcacagccaaagaaactatcaacagagtaaacagaaaacctacatattgggagaaaatttttggaaactatgcatccaacaaaggtctaatagccagcatctttaaggaacttaaacaaatttacaagaaaaaaacgaccacataaaaaagtgggcaaagaacattaacaggcacttcaaaagaagacatacatgcagccaacaagcatatgaaaaaaatgtgcaacatcactgatcattagagaaacacaaaccaaaaccacaatgagatgccatctcacccaaatggctattaaaatgtaaaaaacataacagacgctggcaaggttatggaaaaaaaagcaatgtttatacactgttggtgggagtgtaaattagttcaaccattatagaagacagtacggtgattcctcaaagatctaaagacagaaataccattcaacacagcaatcccattactgggtatatacccaatggaataaaaatcattctattataaagacgaatgcacacatatgttcattacagcactattcacaatagcaaagagatggaatcaacctaaatgcctatcagtgatggactgaataaagaatatgtggtgcatatatatatactggaatactatgccaccataaaaaagaatgagatcatgccctttccaggaacatggatgaatctgaggccattatctttagcaagctaatgcaggaacagaaaaccaaataccacatattctcacttgtaagtgggagctaagtgatgagaacacacagacaaatagagaacagcacacactggggtctactgaagggttgtgggtgggagaagggagagtattgggaaaaacaaccaatgggtactagactaatagctgagttatgaaataatctatacaacaaacccccatggcacaagtttatctatgtaacaaacctgcacatgtaaccctgaacttaaaatagacgtaaaaaaagtaaggctctcattgatttttgaccgtgaagtcatgaaatacaaactccatttcagaaagtctcatctggcagtataatataggtgtgggttagaattaagagagactgattgcaaagaaaggaacaaaaacattggtttgacaccttctgtgtgtccaacacactgctaaatactttttacacaaagtatacttcaataggaaacagtgagagactaagacaaaatgggaaggttagctataattatggggtaacctttcagtgatacagagaaaaatacatataaatgattcaacaaataaaatagaaatgacaggctaccattcgtttagtgtgtaatctgtggtgagcactgtgttaggtactccatacttatcacctctatcctcacaacaatcctgcaaggtactattattcttattgctaccatttttcatattaaaaaaatctaaacatcagggaaatatttaccagggaaataatacctgcaagatactattactattactattgttaccatttttcagatgagaaatctaaagatcagtgaaatatctacctatggagtagaactggaattcaaacacaagtcttttgaactcaaattcctgttctctaccctataatgtcacatacaatacaaaaatatgttattgaagaaattagtgtaattctttaatgcaaggactctttaatgtaagttagtgaggatgataattactatgacagtaaaaacactttaatgtttgagaaaggggcaccaggctaggtaaaactaggattagagattcaagggcaaaaggaaatctttcaaagctggaatggatttatttcagtaacaaagaatagattataggaaaagatataacatgtcaatttttgtctcatttattctgagggcaggcaattttcactttaatgatcccgcttctcactagttcattttctttgttcattttaaagtctttatttcctgtcggatttattcccttgactaagcattctttctccaaattaagactttgcttctcattattaatgatttgatagcacagactggcagctatcacctaaatggaactgttaggaaactgtaaacaaacacaacttttcagctttaaaaagcatagatggcagatgcaagaattctggcaaagccatgtgaaaataacatcagttttaaaaatctaagcctgagattgaagcaggccacactgtatcttttacttacgattattgattctgattctatcatagagaatcccaattcttcagctgttagaggctgaatgaattccaatattctttagttgtggcccaaatggtctcctgataaaatatgttgaagcatgagcaatttcagcaattttttctgggttactagtctactattccatcagaattaatttgctcttcaaggtgaaaagcatttcctcggacacagagttaagtgattattgcaactgccatgtctctttaagctcaggctctcgcctgatttcctttggcattaggcagcaaaatggatttttttaaatactggcaagctgtccaaggtcttcactcaaaaagagagccaagaactcccaaatgtaaaccttgaaatagaattacaaattaggtacactatgacaaatgaacaaggtaaatgtgaaaagtgactaaaagttaacttcatcattatccagaatgtgaggttaaaagaaaggtgaattattactacattttcaggaaaacattacaattagctcataagtgtaaagtacagattctcaggaaaattctaacagctgagttcttctactagaaagtttaattcaagttagagattataaagagattagaaagaacaaaagtatcaaaacaaaaactggccaataatatatctgaagagtatataaaaatggtaacctcacaaatgtcataaagttcaaaacataaaaattaaaatattttagaaaggaagtttactgcccttaatagaatgctcataatatagatgcatattttaacatcaaacacattttaagcacatgcacaatgaaatactgtgcatcagtgaagtccataaaaatgtgcaagaatcattaacaattagaaaaaaacaggatgtcatcaaccaccaaatatacattcttatcacctgcacagggaacatactcaaagattgatgacatgctcagccataaagcgagtctcaataaattcaaaaaaatcaaaaccataccaaccatatttttggaccacagtggaataaaaatagaaatcaatgccataaacatatctcaaaaccatccctcaaatcttttcaatttcatgaaaactaaacaacttgctactgaatgagttttgggtacgcaatgaaattaaggcagatatcaaaaaaatctttgaaataaactaaaacagacgtaacataccaaaatctctgagatgcagcagaagcaatgttaagaggaaagtctatagtgctaaatgcctacctcaaaaaatttttaaagatctcaaattaataatctaacatcacacccagaggaactagaaaaacaagaacaaatcagaagaaaagaaataaataaaataaaataaaatcagtgcagaagtgaatgaaattaagacccaaaaattcatacaaaaaaatctataaaaccaaaagttggcatgaaaggataaataagatcaataggctggcagctacattaacaaagaaagaagagacaatatccaaataagcacaatcagaaatggcaaaggtgacattaaaaccaatcccaccgaaatacaaaaaaaaccctcagagactatgatgaacaccatatatatacaaactagaaaatctagaggaagtagataaattcctggaaatacaccatatcccagggttaaatcaggaagacattgaaaccctgaatagaccaataatgaattccgaaatggaatcagtaataaaaagcctaacaaccaaaaaaaaaaaaaaaaaaccctggaccagaaggatttacagctgaattctaccagacatacaaagaagagctggtattaattctgctgaaactattccaaaaaattgaggagaatgaactcctccctaactcatgaagccgccatcatcctaatatcaaaacctggcaaagacacacacacacacacacaaaagaaaactacaggccaatatacctgatgaacagagaagcaaatatcctcagcaaacaaactaaaagcagtagtgcatcaaaaacttacgacgatgaaggaggctttctccctgggatacagggttgattaaacatatacaaaccaataaatgggatttaccacataagcagatttaaaagcaaaatcaatatgatcatctcaatagatgcaataaagataccttcaataaaatccaacatcccttcatgataaaaaccttcaacaaattaggcatcaaagaaacacaactcaaaataataaaagccatctatgacaaactcacagccaacattataataaatgggcaaaaactagaagcattttccttaaggactagaacaagacaagtatggctactctcaccactcatatataacatagtactgaaagtcctagctggagccatcatgcaagaggaataaataaaaggcatccaaatggaaaacaaaaattcaaactatctgtcttcactaatgatacgattctatgcctagaaaaccctaaactccaacaaaaagctgttgaaacttataaatgacttcagcacattttcagaacataaaatctatatatgaagatcattataatttctatacatcaataacattcaatctgagaaccacagtaagaatgcaatcccatttacaataaacacacaaaaaacgaaataccaaggaatacagctaaccagggaggtgaaagatctctacaatgagaactacaaaacccactgttcaaagaaatcagagatgatacaaagaaatggaaaaacatgccatgttcatgggctggaagaatcaatatcaataaaatgtccacactacccaaagcaatctacagattgaatgtattcttattaaagtaccaatatcatttttcacacaattagaaaaaaactattctaaaattcacatggaatcaaaaacaagctcgaatagccaaagtaatcctaaaagaatgaagccagaggcatcacatttcccaacttccaactatactatacagctacaataacaaatacttcatggtactggtacaaaaacagaaacatagaacaaaggaacagaatagagaactcagaaataaagccacacaactacaaccatctaatcttccacaaaaataaacaatggggaaaggacaagctattcaataaatagtgctgggatacctggctagccatacgcagaatgaaactggacccttacctttcatcatacacaacaattaagaaaagatagattaaagatttagatgtaagacctcaaactctaagaatcttagaatgaaacctagaaaacaccattctggacataggtctgggcaaagatttcatgataaagacttcaagagcaattgcaacaaaaacaaaaattgacttaaaaccttctgcacagaaaaagaaactataaacacagtaaacagacaacttacagaatggtagaaaatattcacaatccatgcatctgacaaaggtctaatatccagaatctataaggaacttaaaaagtcaacaagcaaaaaacaaccccattaaaaaatgggtaaaggacatgaaaagaagatatacatgcagttaataagtatgtgaaaaaaatcctcaacattactaatcattagagaagtgcaaatcaaaaccattgaatgcaatctcacacctgtcacaatgactattattaaaaagttaaaaaaaaaacagatgttggtgaggttgtgtagaaaagggatcgcttaaacactatttgtgggaatgtcagttaattcagctactatagaaatagtttggagacttctcaatgaacttaaaacagaactaccatttgacccagcaatcccattactgggtgtatgaccacaggaacacaaatcattctaccattaagacacatccacgtatgctcattgcagcacttttcacaacagcaaagacatggaatcaatctagatatccatcaacggtggactagataaagaaaacgtggcacatatacaccatgggatactatgcagccataaaaaagaataaaactgtgtcctttgcagcaacatggatgcaggtggaggccattatcctaagcaaattaacacaggaacagataaccaaataccacttgttcttactcgtaagtgtgagttaaacactgaatacacatggaaacacacatggacacaaagaggggaactacagacaatggggcttacttgcgggtgtagcacgggaggagagtaaggatcaaaaagctacatattgggtactatgctcattacctgggagaataaatcatttgtacaccaaatcccagtgacacacagtttacccatgtaacaaacctgcatatgtacctcactgaacctaaaataaaagctggaaaaaaaaaaacaaaatagccccatctcaataatacagaaagaataacaaggattaattcaaaaatgtttatcacataaatatttaggaattcaaaaattaataatgtaatcagacatatttcctatattcatatactatatacttccttcgtatatgttatcaggaattaaacatggtatttgtaatacaggatatccttctcatcagtgagagtgatgtactattacctaagaaaaatataatttgacttaagatcctagcgatatattgtgaagtcaataatatagtttacaggggtattttatttcatcctcaaagaaactggcgaggtattcattatttgaaaaatcacccaacaggggaagttcttctcagatcataaatattccatgttagaatttttctcatatgcctacaccgaaatacaggttatcaaacagatgtttttatgcccatgacctgttctatcaattcaataaatgtttgctaagcatgtgagtgaggaactatgctaaggacaaatacatgcacacacacagattaatattttccctgtcttcaaggagcttataggcaaagtcaaaaaagatgattcatgcataattaatacaaagcagcataatgatgcaaatagttagatctaaatagaaggatcaaaaatagttttcaataagtagagatggtagggataatatatatagacaaaacatgaacgtggacaataagaaagacagacgtgtttgagagtaatccattttatttatttatttagagacagagtttcactcttgtcatccaggctggagtgcagtggagctatcttggctcactgcaacctccacctcccgggttcaagtgattctcctgcctcagcctcctgagtagctgggatgacaggtgcacaccaccaggcccagctagtttttgtatttttagtaaagatggagtttcaccatgttggccaggctggtctctaactcccgacctcaggtgatcctccagtctcagcctcccaaagtgctgagattacaggcatgcaccaccgtgcctggccaagaataatccattttactaaaatatatttatctaagacattactagcagataaagctggaaaaatatgatgaagctagaaatgaagggtcttgaatgcctgagttaaacgtttctatttaacatttgcagtgaggaccagggctagttttgagtaggaaaatgacatgaccagaatggcacttaaggcatactgacttggcagcattgctcagaataaatatgagcagatgaagaggagagactagaagtgggtggacagggtaggaggctcttgaaataactcaggtgaggggaaatgatggtctgaacccacaaactggcaggaatgatgaaaaggtgagaggtcaatctggaagacagtaatgaaagacagaatgatctacttgtaagacattggacatacattcagatccaagatttaccttttgggcaactgactttactcctgattcccacgttgaggataataaaacctacctcatgggattgttgtcaggaataaaggagataatgatttttaacatgtttacacaatgcctagcatgtagtgaaaatttagtacttaataaatgctagcttctagtgttacaattattttgagatattatagtttggtcactgtttactgatttttttagtagctacatctcactgctggttcacgtagcagttgtagtcatctatataccctaaaacttttgtgtgaactactctctgacattaaatctcccccaccttgtatttataccattgatttttaaggaatctaaatataagattttatactaactcccactgaattctatgtttttaccttgagccaagatttcagcctattgagataatttttcatataagttcaattatttgtcatatttgctattcctccctaacttctacaaagctgattagaatacatatggctttttccaagtaaaatattgactcagaccaatccaagaacaaaatatttcactttcactagagaaatcccctctacgttgacattttgtgactatttagaacgtctggacaaaattggacaaagtctgtgaaacataaaaatcaagatctcttcagcaacataaaagagaacaaaatagctcttttctatggctgacagaaagccagagtaaaatttttttaaccgatgcagaaactaaggcttggaaatatcaagcaacttccaaaggtcaccctgctagtaaattgcagaacagagttgtacaaccaaatctgtaggactcacaatctcatgctcttaactgctagactaagttatctccctaagaaagatggttgagattcccatcatgattgctgggaaaaacctccactttggtctctggaattcatctccaaataattaaatgcattttgcaatgataatggttcatttgcaagaacatatacacttttatatgcagtctttgcctttttatgcatttattcagtcaatgaactttcactgagagaccactacattcaaggcaccgtgtgaggcaggatgtgactacagagatcaatctaataatgaacctactgtcaaaggggtatataagaagtaatgcaaaacatatacacctacaaggcaaggcagaaagagatgtatcaagaatggtaaaaagcaagtgtgctagaagttcagaaaaatgactcttttattctactagccattttctcaaggacttcctagattccctaaggttacaaaaagttcttcctgaggtgagggtaggaacaaaaacttacccttctgattctggatttttccattaatgtacctacagtacatacgtgtggttaatggtattgttttcaatatataaatgcaggtcaacatgatcctagttctacattccctaattcttgcaaaacctgttaggagatttccaaccttagttgaatcaccttgagtcaccacatccaaaaggtctgttcaactacataagaaatagattgttcaggttagaatgttcttttgaacattgtataccactgcttaagatttagcaccactataaaaaattatacatgctaaagaatcagttatgttcctataataagcctctatttacatttcaaaaaatttgcctcccaagattctctaaatctgatggaaattgggtaagatagccacgaagctctctccaaattctgaaattgatgcattcctgataataagctctagaaattgggttagaatgtgtttgaaggtaaactttgtttcagaaacaccatttggtttttaggcaatctaatctgactctactgatctttaaaacttgatgaattttagaactaaattaagtatattttccaaaagtagggacctcactcccagagagtattctcaagaatagcttggcattaaaaaaaactgaaaatccttcaaggtaaatcttgaaatcttaaaatactaaaataaaatacctcacacttcagaaggctgacatgtaattaaatattttgcattggaaaagaaagtaaaataacagaaaagaggcatagttgctgaacaaaattgcacaaaacctgccaatgcaacccctttcaaaccaaaagctttagatgctgcttgtgtcaagagaaaaaaatacataacacgtttcatcccttaagcttcttatttacttcttaaagacatacgctgatgaggtaatgttctattacaaatgtttaaaaaaaaaacaaaaaaacttttcctggtacctggattctgaaatctgctctaatgatctttatcatcaaatttctctatggcatgctgtgttcacatttaagaattgtatagattgtttatacacatggaggaaaaaacatgaatataaggcttgggaaaacataaagagaatagaaaattttttcagatgatttcacattctttcgaaaacctaaatttcatgagttggtaaagaatgttaggatatttatatttcttcaaaatttacattctagattatataatgtcctaattcaacttagaaaatggtttcagatgcatattataagagtatataaaacagactgacttttgaattaaaatgtatgcaagacaaaatgcaattttaacttgagctagcctttatattacatgcaaaacctccaattgaatacattcaatcataataagaatttaatttttaacttatattagtaaaagtgttcaaactaccatattatagctaatattttaatagaaacaaaaatctccgattcaaaaataaaagttcttacataagatggctggttttgtatttgaaattactgaatcagagtgccctctattggaagaaaagagacaacaaaagctaaactgaactaagaatataggtaaaatacttccaaaactcaagccacatcattaatatgtaaaacacattaattaaaaatatggatgctacaaaacatatttccttacatttttatttctccaaaataacttttggaattacttgtcatatcacaatcagcaagttggatgtttcatatcctatgaaattaaattttaactgaacccaaatgctcatcatttaaccagtaatataaataacagacatacagaaatgttttccacatttaatagtccaatataacatagaaatgttataattgaggactgtggtttgactgcagtttggattttccttgatgataaactgaaagcctccttgctatgaacctcatgtcggtgtccccgccaagtttatatgttgaaatcctaaaccccaatgtgatggtattaaggagggggtgttgggaggtcatcagatgataaccccttatgatgtgctagtgttcatataagaaaacatcaggagggctgggcgcagtggctcacacctgtaatcccagcactttgggaagccgaggcaggcagatcacaaggtcgggagatcgagaccatcgtggccaacatggtgaaaccccgtgtctactaaaatacaaaaaattagccaggtgtggtggcacgtgcctgtagtcccagctactcaggaggctgaggcaggggaatcgcttgaaccccggaggcggaggttgcagtgagccgagattgtaccactgcactccagcctgcgacagagcacgactccgtctcagaaaaaaaaaaaaaaaaaaaaaaacacatcaggagaacctgcttttttcccctctgttctttgccacatgaagatacaaccagaagacagccctctgcaaaccaggaagcaggccttcaccagctaccagctctgctggtaccttcatcttgggcttctcggactccagaactgtgagaaataaatgcttttttttttttccaagccacccaatctacgctaatttgttatagcacagataatccctaattcaagagacttttagaagctcttacactggggaattgcagaagtaggctggacattaagatttacgagatttgttccatctcaaaaaattctagttttgtggtgttttcaagacctcagttctgactcatcatctcagacctgaattacctcagaaagatcttggctgatttttggctccctagaccagtagtatggatgttagacctgagaagcttttccaagagcaatgctcagagctacccaaaattattttgatttagttggtctggactggtatctgagggcatcagtatttattttttagagcctctctaggtaaatctaatatacaactatggctgagaaccattgtttgagcctctccccagatcaagcaacatacaactaccacttttattttccaaaaatgtcactttcaggagaactctcctacacaagaatttattctcaggatcaattttaaacttctggctagcctcccaatctacttagctgcctttgttctctgacaatagagttgagtggcaaggggttatggctccagctccagaatgtctgtgttcttggctctgtaattaccgcatgaaactgggaaagtcataaaagctccctgtatggagaaataatactatccttttcaaagggttattgtgaggattaaatcagttaatacaagtaaagtgttccataaattgaggtattatcattacttacccaactttatttcctactactttccaaaacaaactctcatcataaatcattctcaaattatgcactaattctcatctctgtgcttttgcacttactgtttcttcaggctggaatcctttctcaatcatttgtcccaacaaaagtgaaaagcacagctcccctttcaccaggacacagcttagtctctccctacctccacaaagacttcaatgagtatctgtaaatattcactggtctctcccttttaaaaattcctttggccacaaggtagcatactatgagaaatgtggctgagaattaaaaacactggctcagagtttgaatcctcactctgccacttggcagctaagtcattttctaaatccatattgttaggattacttaataagcgacttaaatcacgtaaagcattagagtagcaaatagcaaaaactgagtaagtgtcagttcttatttattcagtgttttatatgttagccttcagttatagtctacacactgtgactgaagtctccttaggataggtgttttgaaacacttgaaatcaagaaccatatctattataaatcccacaactcaaaacatggtaagaaccatctgtattaggtgacctatattaggtgacctgtacttgactaaactttttgcaacatgtaagagtataattgaagcaatattctggaaaaaaaacttttttgatgaatagaaacaaatattcaacaaaacatggaatgaattcaaataaaacaggctacagaaaagggtcaaagtaatttgattactttttaaacattcgctaacaggtttctatcagattcatcttctgaaaggtcagttccaatgatgtcttttatctgcccaaaatcctttagatttttctcatttcttaaaaaaaaaaccaaaattcttagcctgacattcataattatccatgacctgacctcaaactacacttctactctctcatctttcccctttgtaaactctattcttccaaataaacagaattatttgctcttactcatatataccatctgcttttctccctccacataatctttaatattttatagggaaatattttcaaagaacactattgtaaaggtttgtcacaggaacgaagagtggtgttagaaaagcatgagttcagatttcaaaaccttaacgctcaatttatgagcattaatttctttcttgccactatcacaatacagtctttggcttacaaaaaaaattgaacatcttttccccaaactattatcactctctcaaagtcaaaagcctttgccgtaacttcctgaaagatagaagcttgaatcatggtctccaagcagcacatacagaccccagggcatataagatattcattgggtaaacgaaaaataattagagcttctgttttacacttattctctaccttcctcaatttgaatttcttttgttgtgtatgtctcataatttacatcaaatattactagaaatgcagtctatatatatataatttacaaataatcagggatatttgctcaaaatttgtttactaatggtacgtacaacaaaaaagtttggaaaccctggtctaaaaaattagggctttcagaatatctgtggttttacaagtagaaggccagaagctgccagtttacataaatctttgaggatggatctaaaaatataaacactatgtgttgtttatatagcacaaatatgttttaagttctaactaactttcaaggaaatattaaaatgtaactgattggtaacctggagacagcatacacctatttcagattttttaacagaggattttgtcccaacattaaagttactattataaattatttcattaatataaaaatttcatttggtaaaacttacaggtatttacttcagtacatatacaactgttcatagttattcataaagaatttttattggggccaataataggatgtttttacaaaagagagtgaagcacaaaaacaaaatgaaacaaaaaaagcaggccaaggaggtaggactagccatggaactagattagcaagtgctatcccaggaaacagtgtcacagcttactttaagtaactaaattaagtaaatgttctcataatggacagtcactatacttagcaagtttttttttagttttcacaaataatatgacatacttaacacagttcactctattactggcttttgaataaagtatgatatatctgtaacaaattaagttctaaaagtgactacagatttcttatcagaataatgtatttcctttaataccagtatatactataagtccttcctctacaggacaaaaagtaggtttaaatatcttaatattaaactgatttattctctatagtttttcttgcttttgtgttcatataaaaatccaaatgagtgagaatcacccatggcctgacctcaatctatccttctaatcttatctcccctctttcttctttgtaaactctcattcctaataaatagaaatacttgctcttactcaactatatcatctgtttttctgcctcacataacctttaatattttatatggcaatattttcaaagaacactatcataaaggcgttgtcacaggaactaactcatgcttaagattctgagcttatcaaagagaaacctcttgggatttgcataatattataaaaatatgcagactgaactttccacatttctctcctactatgacttcaggaggaagtgaggaaactatacgtgtggctctgctctgttagtctgagttcatagagaaaatggggaagacagtcgaaaggaaggtttttgtctttttttgggaaccaacatcattatgcccagtaaaactaaaggaacacaacaacaacaacaacaacaaataccaaaaatccatgtttttaagaaagagtctaaaagtagagagaccatgaagtgatctgtcaaagcactccttcccctacacatgcactgcgagtaaaaccccaaagaacgtcaggaaaagagcaataaggaaactgacatcttagagtggcggaatctgataatgcaccacatcccatacctcttaagtgtacacactgaactggcaaagacagacacattatcttcattcccccccgccttacttactacactctggcttccatttttcccaagttcttcctctgaaatcttgctcaaattatctaagtagtggtctgatattgtgtggcacaagtcttcaaacgaataatccttttcttgacagagttttatttcatccaagagttttgataattctccagtgacggtttcacctatgagaataattttttcagaagtttcaagaaaggctattgttaaaacttaatgttaagcaataaaaatatgactgctatggtgatagaactcaaaatataacaagattaagcagtcagacactattctgctgaaaacaaggtactcaaccataattagtacaacaatattaatgggcaaaagagattataattttgcctatttttattctttttcaaaatagaaataattattgtaaggttatgtatacatagtacataaaagcatctggaattacaattcccaaagcttcacttattataggatttaatttccataatatttcattggtattttacttcactgacagaattcattagcaaatttgaaacggtgctgagaaacttcttcctaggttcaataaacagaaatagtacaagttatttaaacaaataataacataggtaatcagtaccttaagaattatggtatatgatataaagtaaaaacacaaaagaaacaaacaatatgcatcatctgtcaaacatgaagattttgtagattacatgaaaatatgcacatttctaaacagtctcagaaagataccttatacctgtaatttattctgaaaaaaatgcccagcagttacaatccagattttaatatttttattctgacataaaaacatatttaacatcagctgactatagatgcatggatttatttctggactttattctgttttattggtatatatgtctgttttcatgcctgtaccatactgttttgattactgtagctcttcacaaggtttccaagaacacaaaatgtggaaaagatagtctcttcaataaatagtgttgggaaagtggatagccacatgcaaaagcatgaaatatgacccttatctcatcccctatgtaaaaatcaatgcaaacagtataaagactggaacattaagacctgaaaatatgaaactcctaaaagaaaacatagggaaaaaacttgatatttgtttggacaatgatttcttggatatgaacaaaagcaaaaatgaacacgcaggattggatcaaactaagaagcttctgcactgcaaataaaacaatcaacacactaaaaagataacttaaggaatgggagaaaatatttgcaaaccatagatctggtaaggggttaatgtgcaaaatacataaggaattcacataactcaatagcaaaaacacaaataacctaattttaaaatgggctaaggactcgaatagacatttcttcaaaaaaggcacataaatgacccaaggtatatgaaaaggtgctcaatatcactaataatcaggcaaatgtaaatgaaagccacaatggggtatcatctcccatctattagaatggctattctcaaaaagacaaaagataggaggtgtttctgaggatgtggagaaagggaaccctgtatgctgtccatgggaatgtaaaatgttaaaggctctatggaaaacagtatggagattcctcaaaaaattaaaaatagaattaccatatgattcagtaatcccaccttggggtgcttattcacaggaaatgaaaccagtatcttggagagatatctgcacccttctgttcattgcaacattcttcagaacagccaagacatgaaaacaactgaagtatacactgtcagatggatggataaataaaatgcaatgtgtgtatacatttatatacacactacacaaacaatggactattattcagccttaaaaaaggagatcctgccatttgtaacaacatggatgaacctagaggatattatcctaagtgagatgaaccaggtacagaaagacaaatactgcatgatctcacatgtggaatctaaaaaagtcaaagtcataaaacagagagtagaatggtgaatgccaggggctggggagtggaggagatgggaaagtgttgatcaaagggtacaaaggttcagttatgggggattaataaattctggagatttaaaatacagcatggtgactatagttaataatattctattgtatacctgaaacttgctaagagagttgatcttaagtgttctctccaaaataaaaaataaaaaatactatgtgagatgatggctatgttaattagcttgattttggcaattattccacaaagtatatatcaagttgcacactgtaaatatatacaatttttatttgccaagtatacctcaataaagctggggaaaaacacatttaagaaaaaaacacatttaagaaacatatactccagataaacttcattacagcagggatagttttctgctttgctcactactgtatctcagggctgagaagccctaatcagtaacaggagctcttataaatggatgaaatatagagtataggatataacctattagacttgaaattttcacaactgtacatacaagtctagtatagattccagggctttataattaggtactcacttttggtcttttgggaaggagactcaacaggagatgaaatgtgtgtttcttgtgttgcatcttcctgtacaggctcttcgaggactgtagatcttcccacgccttctaaatactctgtgtgtatacatttttgagattacatacttgaattcatttattttaaaatcaataaattttaagttttacttctggtaatcagtttttcatttattttttcatatcctaaatatatcctaagttttcaaaagaacttcaaaaaaccaaacatatcaaaagaacgccatgatgagctatttaattaaagttgtaattaaaaaaagacactggattatttgggagaaactcttgaacccctttcttctaaaacctaaacttaaaacattctttccttaaaaataaattcacctattgaagatacaataaactccttggtctccttattttccatctgaagattttaaactgtctgaaagatgctttgaatagatttaatccccaaaacaggaatgtcaaattcagatggataccacaaccagccaggtaacataaacgaatgaaatggaataagttcatttcaaaatggtgctgtaatcttgtaacataagcataatttgcatattaactttatttccacaaagaaataatgttcattgccattattcttgaagtaatgtcctatactcagcctatttttcatttttctagttttgatacagatataatattaggaatagcagcttaaacttaaatattgcttactatggacccagcattgttctaagtgttttgtataaattaactcatgtaatccttacaaaactatgacacatgcactaaattttaaagattacaagtaaaggaggagtattattaacttgtccatgttcattcagctaataggtggcaaagccaaataaatataagacaagaaaacatctcacttttctcttaaccataaagaaaacagcatctgaatgtagaaataaatgttaaccaatattcagcctcacagaccatgttgaaccagagaacaaatgaccaatctaaagttcatccctgaaataaaacttcttttagagaaaccaaaactccagagtttgagctaaaatcctagggttttttttgtttctttttggttgtttgtttgtttgagatggattctcgctctgtcgcccaggctggagtgcagtggtgcaatcttgactcactgcaacctccgcctcccaggttcaaataattctcctgcctcagccccccaagctagctgagactacagatatgtgccaccacacccggctcatttttttttgtatttttagtagagacagggtttcaccatgttcgccaggctggtctggaactcctgaccttgtaatccgcccacctcggcctcccaaagtgctgggattacaagcgtgagccaccgcaccctgccaaattctagatttttaaatgttaacagctaattcaatttttatggaaacacaatgtgggctcaaaatatgtgatatatacaaagcatgtgtgctatctgccaaagcgttcagcccacaagtggctagtttgtagcctctgtataaagattaaatgaacagatcccttttcatacagagcatttgcttatacttctttattcaagaacctttttcttaaaatctaataaagaaaatttgtattctcatgccaaacaagtatgtcctcataccattcaaataatttctaccagggaaatccaggaatgcaaagaacagagatgacgtgttcacattctgaaatttgccagtaattagagaacttcaaagatgtactgtatgccctaccacaaattaacatacctaattaatcttgaccatttaggagagcaaagatagttactcccatgtaacaacatttcatcttatataaaccaatgcagtatgtttttaaaaagtccatggttatgtcacaccccattttctagtgggtgacatttattttgcttttcccaaaagacatattacacacatgcttcagttttgtttttttgtttgtttgtttgttttgtttggtttgtttgagacggagtctcgctctgttgctcaggctggagtgcagtggcgcgatctcggctcactgcaacctctgccttctgggttcacgccattctcctgcctcagcctcccaagtagctgggactacaggcgcccaccaccgcgcccggctaagtttttgtatttttagtagagacggggtttcaccgtgttagccgggatggtctagatctcctgacctcgtgatccacccacctcagcctcccaaagtgctgggattacaggcatgagccatcgcgcctggcccatgcttcagtttttaaaagttcagtgagaggcagccgggcacggtagctcacgcctgtaatcccagcattttgggaggccaaggcgggtggcccacaaagtcaggagatcaagaccatcctggctaacatcgtgaaactccgtctctactaaaaataccaaagaaattagctgggcatggtggcgggtgcctgtagtcccagctactcgggaggctgaggcaggagaatggtgtgaaccggggaggcagagcttgcagtgagcccagagggcgccactgcactccagcctgggtgacagagtgagactccctctcaaaaagaaaaaaaaagttcagtgagaggctgggcgctgtggctcatgcgtgtaatcccagcactttaagaggccaaggtggctggatcacctgcgttcaggagttggagaccagactggccaacatggtaaaaccccctctctactaaaaatacaaaaagtagccagacatggcggcaagtgcctataatcccagctacttgggagactgaggcaggagaatcacttgaacccgggaggcggaggctgcagtgagccaagattgcaccactgcactccagcctaggcaataagagcaaaactctttctcaaaaaaaaaaaaaaaaaaaaattcagtgagagtcaaaagtccaacatgaaatacaaagtgcatagagggagaagactaataaaaaatagtatgtgccactcttattttttagcttttattcaatttaattttaattttaatttatataaaaggctatgatgggatttttctctgattcatctctgcatgcatttgacttgtaattaacttctttattgataagaaaattgtaggggcatgaacttccctgaaatattttggaaatagagaagagagcataatggccacatatagtgcatctattccttttactcctccttggcctttgttgactattgtatctacatgttccctgcctgacttggttttaattcatttatctccctgcaaaacaatgctgttcttcagcttcccaactgacacctaataaaacctatctcaccaccctcctctatcatacttgcagccaatccataacaagtgtaggagataatcactgctgaacagggtaggagctaaaggagagaaaaacatctggggtttttaagtaacatgctacatgtcaggcctaatcaccaaacaggaagagaaagcatttaagtctaattttgttataaaacttttagttcaagtggagaagtatgcaagctgcaaataacaaaagtcgtacctagacagttgtcaaactttcaatagagctaatgactgccactaacaacaaatgcacttaaatgacttttaccaaaaactaaggctggtaagactgagttattttataccattggattaggaaggaaataatctgtattcttttggctaaatacaatttttgttattattgataatctagcatttagatacaagctctgccacttaagatacatgaatttgaacaaatcaaatctctcagagcctcagtttcccttatgtgcaaaagtaaaataatatctgacttatgttacttcatagggtcatagaaaccaaagtagtagcaaatccctgaaaatgctgaaagtattattcaaatgtgaaataacacttaatcatcactactttatagccttattaacttccagctcataactacatatttactacataaatatgaattttaaaaatatttctattatcaaatgagtaaataaataccttaacttctttaaaatacttactgagtagttgaaaaacaaaaataaaacattaaaaggtattattatttagtttaaaagtctaccagaaaaaaataaaactagtaagtttgttcaaaagtaaacactaactcaaaatccaaaagaaaactgtaacagttttaatctcatcttaactttaaggcaaactcatccatcattcaatactgtttaccttgtaagagtgttgcaatctggagagatttctgagatggatgttctttcagaatgtccaagacagttctacctaagctatcctttatgttggcatcaattcctgaaagaaaaagaaaaactcactagatatacaccactgaagtatcctcaaaagatactatcactatctaactgctgtaatttcagacatatacagaccaagcattgaaagtgatttttaaaaaattaagttctacacacacacatacacacacacatgcgcacacacacacacactcacacaagattttagcaagaaagaaggcaggggcctgttgctaccaaagattaggaacattcttgatcatcaattaactcttaaagggcactgacccaatgtttaagattgtttttcaggaccctatgatatctttttttttttgagacggagtctcactctgttgcccaggctggagtgcagtggcgcgatctcggctcactgcaagctccgcttcccaggttcacgccattctcctgcctcagactcctgagtagctgggactacaggtgcccaccaccatgcccaactaatttttttttttttgtatttttagtagagacggggtttcactgtgttagcaaggatggtctcgatatcctgacctcgtgatctgcccaccttggcctcccaaagtgctgggattacaggcttgagccaccacgcccggctgaccctatggtatctttgggttataactatttaactcaacagcacactatcacactgaaaaatattattgatttagaatgtgaattcctaaagtataatggtcatgtgatttatattctctgtacaatatggtaaaaatatttagtaaattataatcatgtaccatgtaagtaacataagaacagtcttagaacacttgaatattcacaaagttgaaaaagcatgattattttgaattgttgtccacaaagaatttatccaaatacaaggtcaaatactctatgatatttatttatgcaagattgtatttgtcagtcacactaatcatccacctgacgagcaaacttactgaagtgtgtaactaaaacacctgttattattttagttgtggaaatatatattgtaagaaagaacttattttaacacagcaaatagctttcactgccctaaaaatattatgaattttccaaacacataattgcaaaaaaaaaaaaaaaagccagtttacaggatctggtcccaaatgttagttcattgtaagattattaaatacatgtttaaatttgcataggaatgtgtaaccagcacatattaatatttaggtggtttcctcaaatcatttgttatatcaccacactgcatgacaaagttaaatataaatgaaattttaactttgttaaattgtgtacaaatacaatcacaatacaacagtctgccaatgtttttcatttttttttacagaggaaaataaacacactatagtccataacatgaaaaattccatcagttgtttacaagcatgaatttgtacccatgccttttgatctttaaaacaaatctgaccttaattctagctctatttcatctcaatcagaatgcacatatgaaaataaataagccaactttattgttccttcaaagcactccctttaaaaggttccctttaaaataagtttctgtagcctactaacaatagctactcagttaatgaactaactagaaggacaatttaccttaaagagagggaactcaaatctctgtttaccgtagtccacaatataaaacacagaaaaactattatgttcttcaataaatcaagcaattgtgaaaatttctcaaggatcaattcctctctcttacagaaggcagaaatttcctttttcttttggtagttcatctctaaagtacttaagtgcataaaattgtaataacaaagaggtttgtacttaaaacatctattgcataaaagaagttgcacattgatatcaatgttatctaaatactgaaactcagttctacataatatgaatacatatctgcattttagagtaaaggcaagagggtgatttgtgaagaaaactgtgtcattttcctttgtctattcccaaaatagaaatgttatctgtcaggataagctccatgcagaatcacaatagttacctgtttctaacagaactcgtacaacatccacctttccaaacaaagctgcttcatgaagtgcactccccttttctgtctggaaaaaaaaaagtaagaaaaaagaaagcacggttgcatttggaatgcttacaggttgaaataaaatgctcacattttacatattcatacatatttgctgtaatctcagctctccctaacagaaaggtcatgtggaataaagaagagattctaaaagcaaaatccatcggcttggggattgtaaaatacctctgcttctaaatagaaatttgggccagatgcagctgaggcggatggatcacctgaggtcaggagttcgagaccagcctggccaacatggcaaaaccccgtctctactaaaatacaaaaattagccacaggtggtggtatgtgcctgtaatcccagctactcaggaagctgaggcaggagaatcgcttgaactcaggaagcagaggttgcagtgagccaagatcatgccactgcactccaacctgggtgacagagtgggactccatctcaaaaataaataaataaatagccatttgactttcttatgtgagtatttcaccttctcttagctttagctctccttaagtataaaataagagaagtaatgcccacctcacaaggcttttgtgactatgcaagaagctcatttaatcagcatgcatttattaaacaccaattataggccaagagtagctgatggatattctgaggtatggaaatatcatcctggccctcatatattcacattctatttgaagagacagatgtataaacacagatgctccttgacttccaatagggttacctcctgataaagccaccataaactgagtatcccttaaattgaaaatgcatttaggctgggcgcagtggctcatgcctgtaatcccagcactttgggagccaaggcaggtggattgcctaaggccaggagttcaggaccagtctgaccaacatggtgaaaccccatctctactaaaaatacaaaaaaattagccaggcgtggtggcatgcacctgtaatcccagctactcaggaggctgagacaggggaattgcttgaaccagaaaggtggaggttgcagtgagccgagatcgcaccactgcactccagcctgggtgacagagtgagaatccatcgcaaaaaaaaaaaaaaagaaaagaaaaagaaaagaaaatgcatttaaacacaggtaacctaccaccaaacatcatagcctagactagcctactttaaatatgctcagaacacttacattaacctagtgttgggcaaaatcatgtaacacaaagcctattttatgataaagcattgactatctcatatactgcatatcgctagcctgagaaaagatcaagattcaaaatttgaagcatatcaaaaatgcgacagtttcacaccattttaaagtcgagaaattgttaaattaaatcattgtaagttgggggctgtctgtaaatatttatgataaatgaaatctaaacaatttaatgtagccataaaaaagaataaaatcctgtcattcacagcaacatggatgagcctggagaatattatgttaagtgaaataagtcaggcacagaaagataaataccacatgttctcacatatgtgtgagctaaaaaagttggacccatagaagtagagagtaacattatggttatgagaggctgggcaggggagcagggagaggaggatagggagaggttggtgattgactgcgaaattacagctatataggaggaagaagttctagtattctttagtagggtgatgatagttaacaataattgattatatattttcaaatactggaagagaggattttttaatgttcccaacacaaataaatggcaaatgtttaaggtgatagatatgctaattaccctatcattatatactatatttcatgtatcaaaatatcactctgtacccctaaatatgtacaattatgacatgcaattaaaaataaaaataaatttaaaagccaaaaaaaatttaatgtggcttaagaaacccagatgatattttctccctgctttcctctccgtcccatcctttgcccatcacaaccctcttccaaacctcataccctatgctccaggcatactgaactttctttttttttttttttttttttgagacggagtctcgctctgtggcgcaggctggagtgcagtggcacgatctcagctcactgcaagctccgcctccagggttcacaccattcccctgtctcagcctcccgagaagctgggactacaggctcctgccaccacacccagctaatttttttgtatttttagtagagatggggtttcatcatgttagccaggatggtctcgatctcctgacctcatgatccacccgtcttggcctcccaaagtgctgggattacaggcgtgagccaccgcgcctggcccctgaacactttcataatcatttcatattgctttcttccacagggggtctccaaggctggtctctctgcctggcaggatctaactcctagcactcttaatctagccatctagatatacctaccactagttaattttcagcatgaataagaaccatgtggagaaactgtcttaaaaacatacttctgggccccatccccagagtttctgattcagtcgcctgagattaggccatagaatttccatttctaacaaattcccctgtgattctgtaggtctaaagagtatgctttaagaaccataaacatgtacgatatctcgaatcttagcttaaaataattgcatttataaagacatccctgacccctgaagtttagtgtttttcctggatgttccacatcaatctatattttccttatcacagcactcatataccacattataattttatgtaattgtctggttcccataataaactgtaagttcagcggaaatgtaggccacatctattttttcaccattgtatccccaatgcctagcaaagtactttgaaaatatagatgtttaggaatttttctgagggcaagaagtggagggagggaagaacacaggatgaaaaactaggacaatttgtgagtagtgcaggataagactgattctgccttcaggaagctcaaggaagattccaaagatgaagctttttgagctacacgaatgttagttgtctcttttttttttttttcattctttttcttcttctctcaagaatctaacaagtatcagtaggtcgtgtgtgtgtgtgtgtgtgtgtgtctgtgtgtctgtgtgtgttttcaattgaatagtgtcaaggtagcaattttgttgccctatactaaatgtgatctctaaagtgggattctaatctcaacctgaaatagaaatatcactataaaataacatacaatgtaaaaactcttttttttttctgtttttcttttttgagatggagtcttgctctctcgcccaggctggagtgctgtggcatgatctcagctcactgcaacctccgtctcccaggtgcaagcgattctcctgcctcagcttcccaagtagctgagattaaggcatgcgccaccacgcccagctaatttttgtatgtttagtagagaggggctttcaccatgttgaccaggctggtcttgaactcctgacctcaaatgatccgcccacgtcagcctcccaaagtgctgggatcacaggcatgagccactgcgcctggccaaaactctttaataaaagtctattatataattaacccaatctaaagtagataagtacattattaagcaggcttgaggaacactgaatatcaatgtgatctgactgtatcttcaagatggaatgactgaaatgcccttgaattataatctgactggcatgatatgtagatactgaaaaaaatggaaacaaaaaaataatttgtaaatatacagcacagttttgaaggaaatgagaaactggaaactgattcggctcttaagaaaatatttcaatgtggggcatgaacattttattttttcccttccttaaaaatattccttgaaataatctaattttgctcattctcatgctgtttttcaaccagatttctgattactaatttgattcccttacacttttcacaaaattttggacttgatttcagataaatccttcctgatatagcatacttcagttcattctgaaaacaaaccaaagaatattttaattcaggattgcgaggggaaagaaatagaattccccacagccttagggaaaggcgaggacagaaagtatgaaccccagggggttagctttggaacaggtatttgttccagggagtctgtcaaccaatgctagactagtgcctggactttaaccagccactcaaggtacgagtggcagtggggcagaagacagtctgaagtctaagcaagctgaaagtttaaatgagggacccctacaaaactctaaaacttctaaagaacatcctcagtgaaaattaaaacaacaacaacaacacattgcacagaaggggaaaggatgtctaactaggtcttagttgtagatagagtgaaaaaagtaaatccccctaagaatgcctaaccacaattctacactcacatggtaagtttaaggcaaaattgtacaatctctatgaactccagatcctcatccaaaatgtagaataaagtggtcctgggtttctagtaatacaggcagatataaatgcttagaaaaaagcagatataaatcccctctgtaaaagtacactttcaactcaggcctccaaatattccagcagatgaagctctaagaaatacaaattcaaaattataaattactgaatgtgaaaggaagcatcccaccatgaacaaggattagtaaataaaaatacaaaagaataaaactcacaaaaatttcacatattgaaatggtcaggtatagaatataatacatatgtgataaataagatgaaagaactagaacaaaagaataattatcaaaattgaccagatgtgaaaatgaatcaaatagcattctagaaatagaaaatataatatttaaaatcaatggcttaataacatataaatagctattgaaggggtattaaactggatgatagatttttttaagtacataattgatagggtttggctatgtccccatccaaatctcatcttgaattttagttcccataatcttcatgtgtcatgggagagaccggctgggaggtaatttactcatgggggcaattaccctcatgctgttctcatgatagtgagttctcacaagatctaatggttttataaggagcttttcctcctttggctcggcacttcctcttgcctgccaccatgtaagatgtgactttgctcctccttcaccttccaccatgattgtgaagcctccccagccatgtgaaactataagtcaattaaacctctttcctttataaattacaacctcaggtatgtctttattaggagacatactaataggagacttaattaggagaacagactaatacaataatgcaataaaaagaataagagatgaaggacagagcaaaattgcagaatataagcctacatcatttgtcttccccactggaacaccgaatattaacaactatctgcacacagaagagcattgtcacaagaaccaaaaatcaagtgaacaatcacagtatctggttttaacttcctactgctgaaatagacactgaggagggtggaagagaaagtcttgaatcacgggcgctgcccctctcccattccatggcagtggccatgctgtgcagatagaaaatctgtgcattttaggaagggagaaagcagtgactgaggaactttacattgaactcagtgctgctttgccagagtggacaataaagctgtgtggggttccgccagtgcccacacattgaggggacatttgcaccagcccagccagaagggaatcacccatggaatgtgagtctctcaacaagcctcaccactgcactgcaggctgaagtgctctgggatcctcagtaaacttgaaaggcagtctaggacacaaggactgcaattcctaggcaaatcctagtgctaggctaggcttagagccagtagacaagattggcgcatgacctagggagacagcggcagatatggctaacgaagtgcctatgccattcctccaccaacctcaggcagtgcaagtgcaattcacaacaacaaaagtaacttttcccttctatttaaggagaggagagtgaagagtaaagaggactttgtcttgcatcttagatgtcagctcagccatagtaggacagggcactgggcagagttgtgaagccctaaatcctggacatttctagatgtaccttgggccaaaagggaacccactgccttgaaggaaagaacccagtcctggcaggattcatcacctgctgactaaagagctcttggagcctaaataagcagcagcaataactgggagtacaccatgggccttgttgtctgagaaatgctggcttcaagggtcatccagcacagtcccagctgtggtggctacggtgaacaacttcttctgtttgaaaacagcagagggaaaagtaaaggggcctttgccttgcacctaaggtaccacttcggccacagtaggaaaaaacaagcaggcacacggggtctctgcgttcaggcctaggctcttggacaacatttctgaatctgtcctggaccagaggggagcctactgccctatagggtgagtctgaggcctggcaggactcaccataagctgacaaaagagcccttgggctttaagtaaacattggcagtgacctagaagaaccctcgtggaccagaagtggtggtggccacagggagagtctcctctgcctgtggaaaagggaagaaagagtaagaaggactttgtaatgaagtgtgagtgccaatttagctgcagtaaattagaacatcaggtaaactgctaaggtttttgactctaatccttggcttccagacagctactctggacatgcccagggtctgggggaactcactgccctgaagattaggatacagtgctgagctggcttcaggtctgacccaacacaatcccagtggtggtttccgaaggggtgtttgcatcaccacacccccaggtacaggtggctcagcacagaaagacagactctgtttctttgagagaaaggagaaagaagagtctctgcctagtaatacatagaattcttccacatcttatccaagaccaccaaggcaatacctctatgagtctgcaaaaaccacagtgttagtgggtttggggcccaagtcccttcaaatgcctggaaagtcttcctaagaaggacagatacaaacaggtccagactgtgaagactacagtcaatatctaactcttcaatgcccaaacatcaagaccatccaagaaaacatgacctcaccgaatgaattacataaggcaccagggacaagtcctggaaaaaaaatagatatatgatctttcagacagagaattcaaaatagctgttttgaggaaactcaaagaaattcaagataacacagagaaggaattcagaattctatcagataaatttaacaaagagattgaaataattaaaaagaatcaagcaaaagttctagagttgaaaattgcaattgatgtaatgaagaatgcattagagtctcttaagagcagaattagtcaagaagaaaaaattaacgagcttgaagacaggtattcgaagacacactgagagtctacagccataccgccccaaacgcacccaatctcatctgaaaacacactgagaagacaaaataaaaaaagaataaaaagcaatgaaacctgctttcaagatctagacaacagtctcaagagggcaaatctaaaagttactggccttaaagaggaggttgagaaatagttaggggtagaaggtttattcaaagtgataatattggagaacttcccaaacccagagaaagatattaacattcaaagacaggaaggttatagagcaccaagcagatgtaacccaaagaaggctacttcaaggcatttaagaatcaaactcccaaaggtcaaagataaataaataatcctaaaagcagtaagagaaaataaacaaataacatacaatggagctccaatatatctggcagcagacttttcaatggaaatcttacaggtcaggagagagtggcatgacatatttaaagtgctgaaggaagaaaacttttaccctaaaatggtatatctggcaaaaatatccttcaagcatgaaagagaaataaagaccttcccatacgagcaaaatctgagggatttcatcaacaccaggcctgtcttgcaagaaatgctaaagggagttcttcaatctgaaagaaaaggaaattaataagcaataagaaatcatttgaaggtgcaaaactcactggtaatagcccacagaaaatccagaataaccctgtaattacggtgtgaaaactacttttatcttaagtagaaacactaaacaatgaaccaaaaaataatgactacaatgaattttcaagacacagagaatgaaataagacataaagagaaacaacaaaaagttaaaaagttaggtggcaaagttaaactgtatagtttttattagttttctttttgtgtgtttgtttgtttatgcaatcagtgtcatcatcagtttaaagtaatgggttataaggtagtatttgcaagcctcatggtagcttcaaataaaaaaacatacaatgggtacgcaaaaaaattaaaaagcatgaaattaaagcctactgccagagaaaatcaccttcactaaaaggaagacaggaagaaaggaaaaaaggaagagcagaccgccaaaaaaagagagcgagagaaaaaaataacaaaatgacaggagtaagtccttacttatcaacaataacattaaatgtatatggagtaaactctccaatcaaaagacatagagtggctgaatagataaaaaacaaaacccaatgatctgatgcctacaggaagcacatgttacctataacgatacacacagattaaaaataagtggatgaaaaaagtattccatgtcaacagaaaccaaaaaaccacaagagtagctatacttatattaggcaaaataggttttaagataaaaattgtaggaaaagacaaagaaggtcattatataatgacaaaggggtcaattcagcaagaggatattacaattgtaaatatatatgcaccaaacactggagtacccagatatataaagcaaatattattagtgctaaagggaaagatagacctaaatacaataatagctggagacttcaactccccactttcagcattggatagatcttccagacagaaaatcaacagataaacattggtcttaatctgcactttagaaaaaatggaacattttatctgatggctgcaaaatacatattcttctcctcagcacatggatcattctcaaggacagaccacatgttaggtcacaaaacaaatttttaaacattttttaaaaatgaaaaaatatcaagcatcatccctgaccacaatggaataaaactagaaatcaataacaagagaaattttggaaactatgcaaacagacaaaaattaaacaatatgctcctgaataagtgggtcaatgaagaaatcagaaagaaaatttaaaaattccttgaaataagttcatggaaacacagcataccaaaacctatgggacacagcaaaagcagtactaagaagaaactttatagccatcaatgcctacatcaaaaaggaagaaaaacttaaaataaataatctaatgatgcatcttaaagaatttaaaaagcaagagcaagctgaatgcaaaattaagagaagaaaagaaataataaggatcagagcagacataaatgaatttgaaatgattaaaaaaagacaacagatcaacaaaacaagaagttgttttgaaaagaaaaacacaattgacaaacctttagccagactaacacaagagagaagacccaaataaatgaaatcagaaatgaaaaaggagacattacaactaatatcacagaaattcaaaggatcatgagtggctgatatgaacaactacataccaataaatggaaaaatctagaagaaatggataaattcctacatacatacaatctactaaaattgaaccattaacaattccaaagcccaaacagacgaataacaagtaacaagatcgaagccataataaaaagtctcccagtaaagaaaagtgcaggaccgatgactttgctgatgaattctaccaaacatttaaaaaactaataccaatcctattcaaactgttctgaaaaataggggaagatggaatacttacaaacccattctacaaggccagtattaatctgatactataccccaagacacaccaaaaaaagaaaactataggccaatatctctgattactattgatgtaaaaatcctcaacaaaactccaacaaaccaaattcaacaacaaattaggatttatccctgtgatgcaaggatggttcaacatatgcaaatcaatcaatgtgataccctgtatcaacagaatgaaggacaaaaaacattatcattttgactaatgctgaaaacatatttgatgcagtccaacatcccttcctgttttaaaaaaaaatagtcaaaacacctcaatgtaataaaatccatatatgacagactcacgactagtatcatactgaatgggggaaaactgaaagcctttcctctaagacctggaatacaacaagaacacccactttcaccactgttactcaaaatagaactggaagtcctagctagagcaattaaacaagagaaagacataaagggcatccaaattggaaaggaagaagtcaaattatccttgtttgcagataatacaatcttatatttggaaaaacctaaagactccactgaaaaactattagaactgataaacaaatgtagcaacgttgcaggatacaaaatcaacatacaaaaatcagcagcatttctatatgccaacagtaaacaatgtgaaaaagaaaattttaaaaatcccatttacagtagccacacataaaactaaatacctaggaattaaccaaataaatgaaaaatctctacaatgaaaactgtaaaatactgatgaaagaaattgaagatgacatcaaaaatggaaagatattccatgctcatgaattggaagaatcaatattgttaaaatgtccatactaaccaaagcaatctacagattcaatgcaatacctatcaacataccaatgacatttttcacagaaatggaaaaccaatcccaaaatttatacagaatcaccaaatacccagaatagccaaagcaaacctgagcaaaaagaataaaactgaaggaataacattacctgacttcaaattatactacaaatcagaatggtactggcataaaatcagacacatagaccaatggaacaaaatagaaaacctagaaacaaatctacacacctacagtgaactcattttcgacaaaagagccaagaacatacactggtgaaaagacagtcttcaataaatggtgctggtaaaactaaatatccatatgcagaacaatgaaactagactcctatctctcacaatatacaaaaatcaaatcaaaatggattaaacatttgaatctaaggcttcaaactctgaaactgctaccaaaaaactttgagaaaaatctccaggatattggtctcggcaaagatttcttgagtaataccccacaagtacaaacaaccaaagcaaaaatggacaaatgggatcatatcaagttaaaaagcttctgcacagcaaaagaaacaatcaacaaagtgaagagacaacccacggaataggagaaaatatttgcaaactactcatctgacaagagattaataaccagaatatataaggaacaaaaaaactttacaggaaaacatctaataatacaattaaaatattggcaaaacatttgaatagacatttctcaaaagaagacacataaatggcaaacaggtatatgaaaaggtgttcagcatcattgatcatcggagaaatgcaaatcaaaactgcaaagaaatgtcacctcaccccagttaaaatggcttttatccaaatgttaagcaataacaaatgctggtgaggatgtgaaaacaagggaatcctatatactgtaggtgggaatgtgaattagtacaaccactatgaagaacagtttggaggttcctcaagaaactaaaaatagagctaccaaatgatccagcaatcccactgctggatatctaccccaaagaaaggaaatcagtattttgaagagatatttacaatctcatgtttgttgtggcactgttcacaatagccaagatttggaagcaacctaagtgtccatcaacagatgaaaggataaagaaaatgtggtacacacacacacacacacacacacacacacattttcttggagtactatacagccacaaaaaagaataagattctgtcatttgcaacaacatggatggaactggagatcattatattaagtgaaataagccaggctcagaaagacagacatcacatgttctcagttatttgtgagatctaaaaatcaaaacaattgaactcacagagataaagaagggtggttaccagaggctgggaagggtagtgggggcacaggggttagagggaggtggggatggttaaagcgtacaaaaaatagaaagaatgaataagacctagtatttgatagcacaacaggggcactataatcaataataattcaattgtacatttaaaaataaataattgtaacacaaaagataaatgcttgaggggatggatactcaattttccatgatgtgattattgtacattgcatacatgtaccaaaatatctcatgaacccataaatatatatacctactatgtatccacaaaaattttacatttaaaattttttaaatgactacagaaacaaataagcaaagaaggtaaaaaagaaataagagatggaaaatatgaaagatagaataaaataagaggattcaacatatgtctaatcaattttagaggaagaagatagaggtaaataatagtcagtggctaagaactttacataattgataagacactaagttccaggaccagcaagcaagataaatgaaaagaatacatcctggacatatcacagtaaaactacaaaactactaagataataactttaagacactctgagggaaaaaattgcctaaaaagaaataataattagatcaatagcggacttcacaacaaaaataaataataaagtcagaagaaagtataataccttcatgtgacaagagaaaaaaaatctatcaacctagcattctacattcagtcaaactaccttctaaaaatgagagtaaaataaaaacattttcagacagactaaaaatgagtggttacttacaactcttactgaaagaacttctataggatataattcagaaaaggaactgagatgcaagaagtaatgataaataaagagaatggttaatatgaggctaaatctaaacaaatatttaaaaatatgatagtgtctacttttggcactgatttggcttcacagatactttgataaaggatgatgcacactgtagacacggaaaaggtcccactttatacacagggaatatattccaagcaccccagtggatgtctaaaaccaaagatagtactgaacccgaatgccatcaatcagaattcatttctgttcatgtcttccatccacaaattcaaggccttttccatcttaactaagcacttaccgtgcactatagctgtaacttctgtagtttgaggtgcaacagcaaaactagtacaaatttctttttctttcttctcaacttcagatagaggattcattcttaccatagatcttagcaacctctgtgtacaagtttttcttttctttagtaagtcaagaactttcaccttttcacttagaggaagcactttacagcttctctttggaatatgcaaattgtcagcatcactgctcttgtgctttggggccattattaagtaaaatatgggtgacttgaacccaagcagtgcaataccagaacagtcgatctgataatcaagagggctaccaataggcaagtagtgtctacagcacagagatgctggacaaagggatgattcatgtcccaggcaggacaaagtatgatggtgagagttttcatcatgctactcagaatggcatggaatttaaaacttataagttgtttatttctataattttccttttaatgttttcagaccatggttgactgcaggtatctgaaacagcagaaaactaaacatcagataaaggttgggtgggcggcaggggtagggggaactattatattctagacaatgaaaatacataatctccaccataaataaacaaatctctttctggaaaaagcagatggagcaaacctgggttccagtggcagcttggcttttagtatctctgaaaattcatatatcctatgagaaacatattaaaaacctaacagatacatccatgttgtgtgggaaaaattaaaaataaaatacaaattttaaaaacctaatatggttattgggaaggttaaataagataaacatacaacaaataagattttttaagtgttttattaaactataaagtaatgacaagtattatcaataatatttctattaaaaaagcaattagaaaacctattttaaaagtaacctcaattatgttaatattaattacatacatgtatatcctttacattattccaagataaaaatgctatgttaagtagaactaatgttttcatacaataagaagacacagaattcttcaataaaaacagaaaaggttagtagatgataaacatatttttagcctgtaaaaatgaatctgtttttacaaattcaaggttgctgtaattagcttctttggtaagagaacatgagaactgtcaaatggaatggattggtctcataattctaaggtaaacaatggtaccaagaactatttactgctatcacaatgttgtcacatagtgtacagaatgtaaatatgtcaaacccatggacttttcaaaatatagattaattttgtaataatttccttcttttcatcagagattagaaaaatttaagaatattttgccaaggtgtaaagtaagatttaaaaaaaaatcaagtgccttgtggcttatcacaccctagacagagtccgtgtctaattgtctaatattctcactcaaatgagcactattctgtacatctcagcattctgccccaaatctacaacccataaccggccagaccttgaaaaattctattcttgtgaaatatttagtccaaaacattttacaagaaagtaggaagtctacaaagaaacaacactgaacaaggtgaacccaaaggctcccatccctggagatttcagtcctgcttttcttatggatcaaaattctccattttatttaaattaatcatttaaaaaaaacaaaatttccaaaatcgataatcatgcagtttataacacagtgacatttcaaaacttatccagtaaccacacataaagcactcataacatctcagcaccttttaggggaaaaaaaaaagacaaacctctgaacacagtgatgaaaacagctgagcgaaaagtactgaaatgatatatatgttaacatcaataactgaattgttgatgaaagcaaaagaaattctctcattgattggaaatgcctgttaaagtcaagccttggtagcaccaaagctgagaaaaacaagataagtcgcaagcaaaagggagagaagatgacgttcatgtttacagccctgggtttcagcttcccttctttttggcgttatatatttctgtgacttccatggaagctcagttgtgcatttaaagggatgtttgttatattttatccaaaatttctagatgttttaaagtcgtttttaggttatctattctaccagagtgccaaaacagcagatggaaaagggatgcaaagatgtcagagcttagctgcactggtttccccttccaaatttagcactccaaccataattatcctgaagcctgcgaaagagaataatgagataaagaccgattcttgattaaaggagaaaataaagataacaattatgataagcaataatgattgtggtgacgatcagcagagaaaatagcacagatagcataaaactgtgagaagcaagacccacaactattgtaacaactggtaaataaagataaccttactggagatgaagaaaaaacaactagaatggcatttaactcagaaataaaattccctagtaccctgtttggtacttagccacgtgggcacctcttggaattaaaaaaaaaaaaaaaaaaaacaaaagataacaactcaacttagtgtttgacaacaaacatatgatgtctgaacaagttggaaggcagcagctcttttgcattatctagaccatatctagaggagtatgttcaattgtgggtatctaacttttaggaccaatgacagaatacaatgtgtccagagaagagagtgccaaagaataaaggacctagaaaaacatcgtgtgaagaataaaggttataagaatgtttaaactgggaggaaaatggcacaagagaaatatgacatgtcttcaaataattcagaataccattgttgctattcaaaagaagaaatctccctctattaaactagggacttcaagtcttggtctttactcattctctcttccttcacttcatatcaaaggaagcacccttcttttcattaacattatttctccacttgtgctctttattctatcactttctgctgcttcttgaattttgatcatctctgcctcttgcatcttcaaggcaatctttctccataaacatacacacctttccactatttaaaaacaaaacaaacaaccaaagaaacttcctgtgaacctgctttcacttcaagcttctatccgctatcttacttttctttattccacgctttatgaaaagtcatcttccctcttttaggcacaatttttgcctagttttgttactgctatatcctctggcacatagtaggcactcaataaatatatgataaatgaattgattacatgaaattgtgctgtcttggcattcctcttttaactgcttctttacagacctttttccagaaactccctgaatattctttaatcagcctcttctgtctccctacattctgtttcttgtaagcccttctatctcatggcttcatctcttactcctctgaggctagcctcttagaaagttagcctcatttaaggagcacatccaaagagagacctctctgacccttccgtctcaatcacagcacccagtttgtttccattatagcactcactgcaatttatcatttttatgttgtttatgtgcttattttctgtcatccctactagtctataactccatgggagcaggaaacaaattttcttcctcctggagcatagtgcctggtagcatggcatgagaagtcaggaggggctagggtatcctcatagggaagccagggttcagttaaaagtgaaagaaagggagttgcttgggtagtgagtaaggtaagtaaaggaaggcctcactattaaggtgacattggagaagacacctgaggaaagaagggggaagaaagtcatgagggttagtaaggcagaggcctggaggtaggagtgtacataatgtgttccaacaagaacaacaaggtcactgtggatgaagctaagtgaagaagggcaaagaagagtaggtggtagctttagagagacagtgaaactaagtaatataaaaccctatcagacactataaggactctggcttttcctctgagtgaaatggaaaaccaatagaagtgtttttgagtaggaaaatgaaattacctgactgaatgggatcacttctggctgtttgactgaaaatagactgaagggaatatgttatggattgaatatctgtgtgccccaaaactcacatgctaaggccctaacctccagtgtgactgtatttggatatatggcctttctggaagtagttaaggttaaattgggtcataagggtgtggccctaatccaatggaactggtgtccttataagggaaagaggaaacatcagggaactctctctccattcacgcacagaagaaaggccgtgtgaggatataacaagaaggcagccatctaacaagccaggaagaaagccctcactcaggaatggaattggccggaacttgatcttggactttgtagcctccagaattgtgagaaaataaatttctgttgcttaagccactcagcctataatattttgctgtggcaacctaagcagacaatacagaagccaaaaaaaaaaaaaaaaaaaacggaggaaaactagtcaggaagcaagagatgattaggtcttggactatggtgttaatcttgaagataatgtaaagtagtgaaattctggatacaatttgagcacagaaccaataggatttgctgaagaactgaatgtaaaatctgaaagaaaccgtaaaattctgggccaaacaactagaaggatggcactgccttttgacaaaatgggaaagacttggtgatatgcaaatttttgaagaaaggggtacagatgctagattttcagctttggaaatgctgagtttgagaagcctattagtcatctgatagatatgtccagtagggaattacatacacaaatttagagttagggtggagtctgagatgaagaaatagacttggtaattgtcagataaagatgatattggaactcaagagattggatgaggtcaatgaggaagtaggtatagacagagatgaaaagatgtttgagtactaagccctgggacactccgatgcttagagatcaagaagatgagggcagttaactatggaatagggacacgatagattacattattggcctctccttttatatgctctttgccgtatgactttgtacttctttccacttatatgagttgagtatatttctcttcctctttatttgaggcttggttttgtgacctgatttagccaatggatggtaaccaacatgatgcaagcagaggcccaaactgtgcttgcatgattgagctttctctcttatgcacaatcaatgcccccctgcctagtcccaggaggaagataatagacacgtgcagcagagattcccaggctaacttacagcatcaaacatacttcccccagcttcttcaagaagtcaccagtgaactaaatgaaaaccaaaagacagtcgtatctcagaggtcaaaagaaaacggtggttcaaagaagagacagatactgactttgtcagtgctgatgatgaatcaagtaagaggagaagcaggaattgactgttggatctaaaagtatgtcagtcattagacaacttgacaaaggcaaaaacaaggacttttaaaagtgagggagttagagtggcctcaagagagaatggaggaaagaaattggatacaatgagtaaaaacaagcttttctaactacgttgctacaaaggggtcagagaaaggggatggtaaggagaaggaaatgtgagatcaagagagtttttaaaagatgagaaatattacatctttgcatccttatggaaatggtacagttgagaaagaaaaaacgtatggtattaaagacagaaaatatttgtcagagttcccacgtggacaagaaaggataggatccaatgaacaagtagagaggaattagccttagatacaaacctaaaaggttcatttaaagcaccaggaaggaaagtagacacaggtacattggcagatgtggtggtggaaatttgtgattgcttgtggtttcctcagtgaaataaaagcagtatcatgatcagagagggatgatagagaaggaggtgttgaagttttggaatagagatgtcgtgaaattatcatctagggaaatcagagagtaaatggattataatggataattatcgcctatgtacatatcttatttctggtgccactataagcctttgagagcaaaagctgtatcttacttagttttgcatcttaacagctcttagcatggaaacttgtactttttattattaactttctgtaattttactttcatttcctttaatagtcacataaagtctaattggcttaaggttgtactagttctttaactcttcaagtcttatgagagaaacttataagaaactcacacaatgaaagcactagcatgatatggcactatcgctatctggttacccaaaatcaagttcaaaattcataaaaataattgctaacttcaagagaaaactgcccattcaaccctactttcttaatatcttactttgactgattctctttattaaaaaaatatttaaagactaaagggtttataagtaaagatgatatgaaatttgcccaaagtattacttactattttaaatatgtgttataatttaaaattactcagagagtaatgatgcagaaaataaacttctagagcaaatattaacatcaatgctgcatttaaaaacatatgtaggtcaggtgcagtggttcaaatttgtaatcccagcactttggaaggccaagaaaggaggatcacttgagcccaggagttcgagaccaacctgggcaacatagtgagaccttttctctacaaaaactaaaaaaattagccgagcacatcagcacatgcctatagtcccacctactcaggaggctgaagcaggaggatcacttgagcttgggagttctaggccgaagtgagcatgattgcaccactgccctccagcctgggtggcagaataagaccctgcctttaaaaaaaaaaaaaaagtaaaataaaataaaatcacatgtaactactaggaaaagacaagatcctcaaaagccatctataagttttaaagatttattcataataacttgaatgtaattgaagtctaaaagtacaatactataatttaccaaatgggattacttttaatactaattcccaacaggttagctagagcagtttaatgaatattaaatctactgaaacaatttgaggctactagctacattgttcactctcagccagtgagaatatcaacaaacctacttgatattcaaaaattttgcactgagtctgatgggaaaaacttggtaacaattaatttgagtaataaaattaaatattcacccccccccaaaaaaaaaggcaatgagaccaaaaaaaaaaccaacatattttctatgaacaaagcaacaataacaaaagcaaaatatcaactaaggctaaatatattatggaagattcatttcattgagatatattttagaaagatgttgtcagttctacttcctagaattcttagaatgagtgtcaatagaagaggttatagcaacacagaagttgtccaccttactcagacatcaccccgatacttctgattaggtgttcaaagtgatctaagcatattgtctgcctttcttctgatatgtgaagaacaaatctaaatgtggtgaggaccaagcagacaatctaaaggaatgacaatggcaatgatataaaatggtagaatgaggtcggagccttggaaagcatttaccccatctaaaagcactcaaattcaatattttaaaatactctttagccaaataatgcacatatgcaagctaaaggccacctaaaattcaaagtcgtgttggactttcaaaggtccccttcaaatgtcacttccatcaatgacttctcatgttctccctcttaaaatccatattttcctcacccgtagatccacagctctttgttttagcatttattatatgtcatggatgggagttattcttgcaaattttttgtctcctccactaagcgtggggcagagatagttttggttttttattctccaaaagcacaaaatacagtgttttgcagaaaaaaaggacacatcatatacatttataaaattgaatttaaactctttcccttctggtcatgtcatctagtacaaaacatgaaaggatcttggtcagggataccaagaagcttactgacctcagtcagaggggaagtccttggttatattgcagtctgtgcaatcaagtttaaaaatattacagaagtgtgaaagcagtacatccagattagagaaattcaacatttatacaataaacatctagtttatcattaaacaacttttaggaaaataactttgtgagtcacctacaatagtaagcatacctacttattttcaatacccctttgaggagagagactgtttttccttaatatgactgttagaaaaaattcttatgcttttttgagaggctgccaaagttgaataaataagaaattgagaaaagatattacaaatatctaaactactaaataatgcaggcaaagctctaaagcaagctctggttcagggtgctagccttaaaactgagattggaaggcctgagatttttctaaattcaataaagaaaactctggaaatacaggattcaatctctgaacaattcctaggaaatataaccccatctgtgagcacgcattccacctggagtgtgtaattatttgcaacatttgccacatttagtccctctgggtattcacacccttttacaattcacgccctcttctaatacagaggtagactctattttccaactccttgaatatgggttgcctttatgacttgcttcagccaagcaaacatggcagaagtgaaggtgtactagttccaagcctaggcctcaagaagccttgtacaattctgttctctctctcagaaccatgcatgccatgtgagtaagcccaggctgacctgctgaatcatgacagagaagtggcagtctcacctatcaccctagacaacatccagccagcctctgaaacagaaacacataactgatttgcagttgatttcacacacaagagaacacagccaagaccagaagaaccatcagttgagcttagactaaattgccaatcacagaattatgagctaaataaagagttattgtgttaagctattaagttttgggatagtttgttgcacatcaatggcttactaataaggggagaaggtcacaatatgacagaaagcaaaaaagtctctggaagataagaatgctgccattaacttggaagccaagaaataaccatgaaaggaggaaaaggcaaaaaaaaaaaaaaaaaaaaaaaaagactaaccctggagttggggctaacttaagacaagatatcaaaagtaggctgtggccaggcccagtagcccacacctataatcccagaacttggggatgccaaggtggaaggattgcttgagcccaggagttcaagactagcctgagcaacagagcaagacctcatctctacaaaaaatacaaaacttagctgggtatggtggtgtgtacctgcggtcccaccagctactggagaggctgaggcaggaggatcacttgagcccaggaggtggaggctgcagtgagctgagatcacgccacccaccactgcactctagcctgggcaacagagcaagactctgtctgaaaataataataataataaaatatactaaattaaattaaactttttaaagtaggttgaccattccttgtggagaaacaaaacctatccaaatcctattcttcctacaaagctcacctcaaatcacaccttttccatttttttttttctgagtgtccttaggcatagtgatcattccttcattagttatgtataaacagtacattacggtggaaagaggcctggactttaatcagtaagtctaaattcacatcccggttttatcaactatgtgtccttagacaaatttcttaaatctttgaatctgattcctcatctcttaactgaaatttaatagttctcaatcccaaaggacagttgtgagaattgaattctaaatgtgtcaacatgctaaacacaaagtacatactcaacaatgttaaagtgaattttgttccattcattcattaaactctgactggattcctactgtatgttaggctgtgtgctagatattgggacaaaggaaacaattactaatgataccacacacaactgccatctactaacttctcatgtgtatagccctcaaattagaatgaggttagagattatgccttgtagctcttcatatttcccaaaagtaggtggcatagtaccttgaactcagtagttacaaaagtacttgtgaacaatttgattaaaagatttctacatacaggttttcacatttgaatcccaaagccaagcaacagcatcatcacttttaaagcatagctaaaagcacactcacttgacagctcacatccattcctgcctccagcagcacctgcacgactgctttgtggccattgcgcgcagcaaggtgaagtggcgtgtgcttgcgagtgttgcagctcattaagttaggatgtgcactgatgatcatttttaccactctaagccgtccgtagagtgccgccaagtccaaaggtgtttccagcttgctatttctaattgtcgggtcagtgagctcttctaggagaacagcaactacttctgagtgtccatattgagctgcacagtgtagggcagtttcattttcattgttctaagacaaagatttttaaaaaggcacattttcagaaattcaatttgttatcaaaatcttaacacagtaatttaaaacctgcaatgctttgaaatgtaagttaagatttatccattttaacaagtatgcctaatggaattttatatttgataaaagtatctaggattcattgaatcaaaaaaaaattttttatatcactttaatcgaaaacaatccaacatttccctaaatcatatatgccaacttccaaaaatgacaaatgatttagccatgtttgtcagaggccctcctgggtccagaaggacagtgatatctgcatggtgcatcacatctttagacatttattaataagagagatcaaaacaattataacagacttttaatagactggctttccaaaagacagataagaaggtaaattcttggtaacaaaaggtttatagaaaggtttcccaaattaagtttcattttattttccatgtaagtacaaatcattgcttcctttgcaaagaaaatgaaaagattttggccttaagatataaaagtacctttttgaaatgttatcatgggttgtgaggatggacctagatcagttcccagacaagttactaggagtatcacagtacaacatgtgcagcttataagggttcagttgaaaatcaatgagattttcctagaaatgtatcaagatttttaaaaatgttaagatacagaaaactgaacccagttgcaaggcagagggacccttcagactatttgagcaatataggtagatggtgtataggtatgtcaggaggtggaagggtcaggagaaaaatgaacaagaaattttagtaacaaaaatgcaataaccgtaaatgagggttctggaaagaaagagcagctgccaccatcagagttatcatcatagctaacactatgtactagacatagttgcattttatatatgtttactcatttaatcctcattatgagatagatactattatcattatctccattttacagatgagaaaactgaggcactgaatagttgaataactggccttccgttatacagccatttagtggtaggaccgggatttgaacacaagtagccaagacccaaagtgggtgttcttaaccatcacacataccaccttccaaaataggaactattactactactacttgttgagtgcctaaaaactatatatattgtctcatttaactcttacaacaattctccaaaatttatattaaaattgtctacttcatggacaagtaaactaaaatacaaaaaggttaaattacacatccaagtagaattaagatattttgcaagctggatctgacaaatccaaaacccatgctctttccactataccatgttgtctgccatgtgttgctatattgtcaaagaagagctgggaattagtgatctgaaagcagaatttctagaggttttgctcagaaaaataccaaccgagaatagggagtagctgtttagatagctgttctgatgaaaataaaaggataagaagtgttcagacccaaacaaatcttaatgttctagaaagtaactcaagtttgccctggatgatagaagaatgcaagtaagttgagagtctagagggaagatttgaaaatttaaaaaggagtagagtgacaaggggaaaacagcactaggaaaggcttcttactactttaccttgcaaataagtatcaagagagagcatttgaaggtcaaacccacagggaaaaatctactctttcaagacaatcaatgaaaagttaagacctgttagatggggaatccagctgagggtactgtttcttccatcatttgtcaggagtccttctttacttggtttgaaagtattactataatctacttcttcataaacaatgatcacatacaggtttagactccctggtcttcttatctgtttttcttatcaggcttataaaacagccaatcttattacttcacaccatgaaaacattatacagatatatacctcctgaccaacccaaatttccccctggtctgaaagggattcaatctcagttttcaaaatacagtatctctttgagaaaagagaaaggccagttatgaaataatgattcctcaaaggcctctctactggtccagagccctgagcctaggaaattacaagagcaaaatcgaaaaattttctagtaacaccaattagcactgttcagatctcaagggaaaatatatcaatcattcaagacctactcaggataaaaagttcacagattttatccatgatcatcacatacttggatcgtcacctcagtggacgccacaacggtggtacttttacgagagcatgattgtgtatttgtgtatgctcacaagtgatctaaaataatctaatttgaaataaataggctgtgatgaggcactgattaataattcctagtatggctatgcagaatattcttaaaagttttttaattccttcttttttaccaaatgggtattctctgaaacattaggacccttccagataatggatgatagaacaaaactggctaacaaaagccatttaccaaaaactcttggttcagagtaaaacatctaacaagagttggattcgagtttcggtgaatggcaaaggcaatgtgtttttcagataaggcccctctgggttttgccctaatgttaaaataaagaaaaaaaaaaagaggaagagaaggtaaagggaagaaaggattaatgaaatttaaagaaattgaaaattttcaatttaaaggaaatttaaattgcaaaaaggaaataatcagatgataaaagagaaggatgtggcaattataaaaaccataatccgggtagagtccactttgtttagaatggtgaacaagacctaggttgaagtgttaccatgtaaattacttcatctctccaaacctatcttatctgtataatgagaatattattttccctataaaccttataatatagtttataaaccaaaagagataacatatttttaaaatgcattgtaaactttaaatattaaaatgtagaatagaattatttttaaagaaagctgtattagaaaccaaagataactttcagaaatcagaatgaagccctgactataatgcataattttaacataacataaatgtattactggttgagagcttaggctttggatcagaaaaacctgcgttcaaacactggctgcatttcttagtagctgtgatgttacggtcaatctactctatctctctaaggctgtaactccatatatatagtagcaacagtaatctagggcttagtaagataacggggatgaagtattttgcacaatgcctggcacacagtaaacaatccattaagtgataggatttaggatgacaataccaatgcgctgttgtgtaaaaggctctggagtcaaagtcctgagtctcagtctcagtttcagtcactcagtaacacgtggccttcgacaagttgtttagttttacagagcatgatttctcaactataaaatgcgagtgatattatcaattcagaggattattgtgagaattcattaaatcgtatttttgaggtgaaagtgtttagaacagtgcccgctttaccttatgtctcaataaatgctaattaccatttttatttcctttattgtttaaatacataaaagtttataattaacaagaagattctgtcctattcagaaggaaaaaagaaagctaaaattaaaagttatctataaaaataaaaatcctacatcaaaaaatttaggagaaatggcatagaatgggaaaactatgatcagcatcaaaagagtatacatataacaatgaaaaaatactaaaattatggtattaaaaatcgtaagaaagttgcaacttcttgccaatagaaaccgcaacacaaagcaacagaggtgaacaaaggactttgaatatggtctccttaaaaagacactttttgtaatttaattgatctattcaacattaccaaaaacaagtatttctctttaaaacatatagcaacttttcactttcaaatgtaagtgaatactatatgttatttcttattttcatgtcatttaaaaacatcttgtttgtaaaaactaacatcctcttgtttaaccttggattgtttttccattttattatttcaggtttgctttgcagtattcagacaattttaagaataaccaccagatggctcatctcataaatgatctaactgttggttttctgtggaagagaagagcattgtcataaatttccttttagcatgatatgatgataaagatagccatatctgtcatgttttaaagactgggtgcattcttattaaaatttctgcatttttgtaacctgtaaacatggaaatttttattgtgataaatattaataagatacttttccaattaataaaatgttttcctgattagtcctttcaacaactgcatatatattttcattgaaaaaatatgtatttttcttccctttgctatttacagcaattgttactttttatccttcagtctgaatttcaaagtccggcaaagtctgcatccatttgaacaatatgctaattgtgctttattagatatgcttgccctaaagtaacctacttgcattgatattggacaactgccaacctgcagcttaatgccgtgattgtaattcaattgttggactgtctgctggttttcaaatatagttttacaaaatgggaacagtagggggcatgcagagatcaacatgtttgttatcatactgtattaggggaccatattttactttctagaatctgtggtcctatctgtttagaatactgacactggttttctttttaaaatatgtccattatgtgtaatatagatattgtgtacttacaaatacattaactgtcagaatcatactgctgctgtgttttattcaacttattctgggcatatgtgtttgtgtttgtatatatatatatcaaaaaattttaacttaatatgtgacaagcaactgtatatgctatatttcacattttgattcacaagagtacttaaccatgaaagtgctaagtaaatggtaaagcattatgcaaatgataggcatatcattgttttagcattcaaaattgtattaagaaacattgtaattctcattacacatatgaattctgttctatctttaaatattcaatggctataaaatggctgattatataagacaggcaaaaatatttcagctacttcctttatgtaggattttcccattaacaaagtatctttacaaatgcccaacttagtccctgcatatcatatccaaacaccaaagaatttttcaaatttctccttttaggaaattcagcaatggaaaggcctttgggcaaggtaaagataaaaaaatcacattttcaatatggctttgccttgtaaaactagaaaaattacatcatgagcaaacatttggcaagtgcacctgttcattgaccctggaatgtgatggtccatgatgaataagaatcttcacaatttccacatctcctttccaggcagccaggtgaataggaaaataccctttgttgtctgctacatttgttgatgcctcatactgaagtagtttgagaactatgtccctaaaaaggaaaaaacaacaacaacaaaataggctgagcaagacaaactgtattaaataggtaattttaaaagaatactagatgctgggtgggaatttagagtaatcattcaaggtactaagatataaagttgggtttcaaagtttttgcctactcaacatttggctattttacttacctggaaaaccatcaccccatgccacacacacacacacacacacacacacacacacacacacacacacacagagagagagagagagagaaagagagcgagagcacacattgactaaccaattaaactacttaatagaattcatataagcaaaacttaacttatttcattaattagatgagctaagtaaaatgaagaggataccaactcccatttttttttttaaaaaaagagctctttccagatagcccatatctgagatttagtttgaaggaaaagttgaagttacaagtatattccttgtttacacacacacaaaaagttatcataataccaaggaggcatttataaaatttacacatcattcctacagataattggaataagagatttaaggggtatgtaaaagagaaagaaagtgcagtatgtaagggacccttgacaagctaactgtagtactagcccagggttaaaaaataataataaaaaaattttaataacttctcagtgatggcacacaacacactttgagtattccttgttcctacttctgtattccttcacctttcttctccaagcataaaaaattatttcaaaagggaaactcatttaaaagacaagttccaccattaatgcaatttcaacacatattcaatatatcctacctcaaaaattttgaacttaatccccaccaggttttcaaagtaaaaatcctgacctgcattactcaaccttagaaagaattaattaataattattagcataaattatatcaaaatatatgtcaacaatcaaaagcagtaattctaaacaaaactgtattttcatttggatgcatttaagaagcaaattctattaactcactaaatgaaatgctagtcagacacacataaataaaaatatatatataattacaatatataataaagttgtttcttacatacaacaaatcactaatggggagggtgaacataacagatttacatttaaacatttcataaaatcagactctagatgcaagtaacaaatgaaaacatttggaggaaattttaatagaaggaagattagaattttgatagctcacaagaaaaacagatatgatatgatacaaaattatggtaaatggtaaaacatactgtccagaatgtgtcctaaagtcacaacatttgacttaattgctaaatgtaagaaatcatgattttaaaaaaacaagaatatgttgtagaaatatttagaatccaaggagtcctaaattgtctaatgatataatttctgagaaattaagaattaaattttaacatttctctttgaaaaaccagcattattttacgaaatctgaatttagaagacttggatttgtgtcccagctatgcaaactacctgaggctgtgattccggagaaatgataatcacacaccacataatgataattcgatcaacaacagaccatccgcatatataatggttgttcaaaaagattatcatacctcatttttactgtaccttttctatgttttgatatgtttagatacataaatactttctgtatctattgtgttaaaattgcctacagtattcagtacagtaacatactgtgcaggcatgtaactcgggagcaacgggtcataccatgtagcctaggtgtgtgacaggctatatcacttagatttgtgtaagtgcactctatgatgttcacacaatgatgaaatcacgtaattagacatttctcagaatgtatccctgtcattaagaaacacatgactgtacttagtctcattttctttttcttcaggagatactataatgataatgtctactcaaaactggtaatagcattaaataagatcataaaaaagaattcactcaataaatagtaaagcactataccaataatagcacttgtcccaagtaaaaataaaatactttagaagtgaaatgaaatgcttatagaaagtcaccttcgaaaaacagaatcagaaaatcagaaggaaacttaaaggttatccagttcacacgcttctccccatttccctgccaagcaagggttgttatatagggtcttccattctgacataaataaatacataacttcagtgaggtaatgagaattcaatacctatgaataacaaaagcagataaggaaagatctgaagtcccaactctctactatttacaaacctggttaccttgaggaaattaagtaacctctgtctctctttcagatattgtgaaaatagaatttagagattacatcttggtgctagtttcaaacagttatggtgtgaatcaaatgagaaacagatgtaattgtaaaattatatatacaatcaaaagttgttctcaaggcagattgttgcaatgttaaacaattccagtgattgctttttaaataaaatatttcagcatttaaaaggcaaaataatagcaaaagaagttagtcaaattaaatacctggatctaaaatgtagaatttagcctactacaaaatagacttctccaagttactgtcaaagacaactgtgagaagagaaaaatttcatttcttaatacctaaggaaataaaaaatatattctgaaacaacttctcctataaagcatttcctttcaaggggtaaagacgaaaaaaagattgatgggatcatcaattctatttccttttactcttgctccaatcacttagaatttcatttgttctttggctcaaattttactgacattttctaataatgtaagtgatatacattcattcttcatttatcaggaagatttatgacaagtgaaaaaacgtctattttgaaaactgacttactaatcatttgtattttctagtattaccaccatctaatatctaaatcagaaaagaataatctgtaagtttgtaaaattgcctttggaaaacactaagatcctaactacacattatttacacattatttttaagttttgaaaaatgtatttattttaataaataaatattttgttaaatgtgcttatttttttcttttttaattttatttcaatagtttttgggacacaggtggtttttggttccatggatgggtaacactttagtggtaaattctgagattttagtgcactcatcatccaagtagtgcacaatgtttccagcgtgttgtgttttatccttcactcccctccaaacctccctccaccagtccccacagtccattatatcactctgtatgttttggcatccacatagcttagctcccacttagaagtgagaacgcatggtatttggttttccattccctagtcacttcacttagaataacggcttccagttccatccaagttgccacaaaagacattatttccttctttttatggctgagtagtattccatggtgtatatatataccacattttatttatccactcattggcacttaggttggttccatatccttgcaaatgcaaattgtgctactatacacatgtgtgcatgtgtctttttcatataatgacttcttttccttcgggtagatacccagtagtgggactgacggatctaatgatagatctgcttttagttctttaaggaatctccatactgttttctatagcagttgtgctaagttacagtcccaccagcagcgtaaaagtgttcccttttcaccacattcccaccaacttctattgttttctttttttactttttaattatggccattcttgcaggagtaaagtggtagctcattgtggttttaatttttatttccctgatgattagtgacgttgagcactgtttcacatgtttgttggctgtctgcatatcttcttttgagaaatgtctattcatcccctttgcctactttttgatgggattatttgttttttttcttgcttatttgtttaagttctttgtagattctggatactagccctaatttgcaaatattttctcccactctgtgggttgtctgtttactctgctgattatttcttttgctgtgcagaagctttttggtttaattaggtcccatttatttattttcgtttttgtttaaatgtgcttattttaaaattaaaattaaaattaaaatttattttcaaatttttgtttaaatcgagctttacatcttattcaaagataccagctaatgaattggttgagctcagatttctagtgttaaaacatatttgtgaaatataaagttgtatccctgatcaaataagtatctgtcagttttactaagttataagtagaataaagtgttaatcagcaaattatgattaatcattcttatgatatatccatatatatccaaagtaatatgaactaaataggccattttcatccaggctcattagaacaatttaaatttcatatataatatctaaattagaagagcagttaatatagtgtagtaccaacttagtatttttattgatacataatagttgtatatattttggggatgcatgtaatatttttatatatgcatacaatgtgtaatgactaaatcaggataattggggtatccattacctcaaaggtttatcttttttttgtgttgggaacatcacaattcctctcttctagctattttgaactatacaatattggtaactttagtcagtctactgtactatcaaacactagatcttattccttctaactgtatttttgtattttaatcaaatctcttctcccccccccctttccttcaaagcctcctataaataccaattaactttctacttccatgagatccccttttttttagctcccacatatgagtgagagcatgtgatgtctgtcttcctgtgcctggctcatttcactttacaaaatgatctcatgtccatccatgttgctgcaagtgacaggatttcattcttttttatggttgaataatattctattgtgtatatgtgccacatttactttatctgttcacttgttaataagtaggttgatcccatatcttagctattgggaatagtgctgcaataaactggggaatgcagatatcactttgataccctgatttcctttttttttttggatatgtacccagcaggggcattgtgaaatcatatagtaattctatttttagttttttaaggaacctccatacttgtcgtccattgtcattgtactaatttacattcccatcaatggtgtacctgcattccccttcctctgcatccttgccagtagctattatatttgtcttttcagtaaaaatcgttttaactgaggtgagatgatactgtgattttgatttgcatttccctgatgattagtgaggttaagcattttttcatatgcctgttggtcatttgtaagtcttctttcgagaaatgtctataatcgtttgcccatttttaatgaaattatttggttttttgctattgggttttttagttccttatatgttctggctattaatctgttgctagatagatagtctgcaaatatttttttcccattctgtcagttgttgaagctgggaaaactggataaccatattcagcagaatgaaactagacctctgtgtctcaacaaatacaaaaattcagtgaaaatggattaaatatttacatctaagacctaaaactatgaaactagtaggggaaaacacctcaggacattggtctggacaaataatatttgggtaagacctcaaaaacataggcaacaaatgcaaaaatagacaaatgggattacatcaagcttaaaagcttctacacagtatttctttaaatattatttaggttgagccttatagcttactttaaggtatccacaaaggaacacatcgcctgtgcttggtcaactggcatgaaatattcagtcattgattgatgagcatttgggttggttccacgattttgcagctgtgaattctgctgctataaacatgcgtgttcaagtacatttactaatgtaaccaaatatcacctggaccacaataacttattgaaaaattaatgttaaaaaattcattgggactgtgaaaaaagaaatattaagttacattgctaatcaatatctgtaaaatagcaagcagcaaaataatccctatgtcttaaatgtaaagtagcattttctgatatccagcatttgacaaataacaaatactctaaaatcctaaagcaaatgtggttgacaagaaaatagaaaaaatattttggaaaatggaaatagaaatggaaaaatactttccatttcccaaaaacaaagtaaaacatcaaattaaatttaataatatccaatgtaaatagctgcaatattttgcagctttaagctaatacatgtaagttcagttaaaaacaggaattctagaagtattgacttttgctgctatatttaattcacatccattttctgaaagatataaatacacatctgattaataaaaaatgtatttcggtaagttcagcatatgctctgagcaaaattaaataaattgggaagagtcaaccttcaaatttctttgcctcaacagcaagattccctgtaattaaatcacaaccaaagatgtttatttcataccatcctctcttgcttgttgattgagtccaaagaatttcaaaataaatgcaaatcatcttcatatggatgcagaattaacatctaatgaaactctcaaatttaataaggtccttttgatttcagattttcttgacacttttacttctctttaatgggaataaagttgcagatgtgttcaagatggtcaaaagatttcaggacaatacgtcccattttctaactgaagtttctttacatgttgaattcactctcatagatttctagattacagagtgaataaaggcaaattttaagtagtctgtatccttatccaggaaaaaaagcaagatgactaaagatgtttctagttattcaaagagcaacttcagagaccagattatacaatttttagaggaggtatgcctcttttattagaaaacctaagaaagatcaaatcatacagatagcttattatatggattctagatccaatttgatacgcaatctggattacagataatgagatctagcatgcattaaatactttaaaaggtagaagaatagaaaatatcttatgtgtatataaaacaatatacatatttcagaaatacaataacgatctgctgatatttttcaaaacagcatgcaagtgtcacaatataccaaatatagtttaataacattaaacttaagaagaaaataaggaactatttgttaagtagagaagaaaaattgaattgaaatatgagtatacaggtttaatataacctcacagggaaagataagattattactaaaaataatggatgaaaagaagagaggagaaaagtcagaaagaaggaaaagtaaaggaaaaaggaatgaggggactaaggaaagcagaggagaacaagaaaaaaagggatgagaagaagtgggaggcagggaaggaaggtagagaggaaggcaggtagtcaggccagccaattgcttttcagaggagaattaagggatttgaatttgcagtagaaatacatgtgacaatgaatcctccatattttaaaaagagaaaaagatacaaagaaatagctctctactctatctatggaaataatttataatacttgcagtaaattttgttttattaaccatgattttttcctatcatttgatggtaataattttctaatctgtgattacaaataacccaagaaatcaccagtagagtacattttccattgtgtcctgatctggctaattgaagatgaatatgaaataatgcatttcaggtacaaaatgctgcttcatttgtggattaactagcattgataaacaatggctcccaatgaaaatgtacaaaattggggaaactggtttaattttcagtatgaaggctttagattttatgttgggggtagggggacagtttgtgttcaaagcaaaagaataaactatatgatcccgaaacattactgctggctttatgattctatgaactttagcctaccaattataatgtttatggaaaaaatctagagcagatggatacaacaacagcgacaaacatggaaatgatgtgtttctgtgcagactgctaaggcttgcttgggaagaatacaatataatcattgttagttacctctgctaagtgagaatgcaaataaaagaaataaccttcttctctggctctgagatacagtctatgacattattttctccctcaaatatcttttaagccaatattaaaattagcattccatgtaaacatatgacaaatgattatgggaggcaggccagaaatatataatgtgacagagaagagccagggagagtttaacaacaaaggggagataatgcagagtactggtaaaagcatagacttagaaccagaacacttaagctctagacacaaccccactttaatatctatgtggccattaagtcacttaactaaatgggcattgtttctccatctataaaatgagggagctgaggggtgtcaggtagaaaaagtgatctctaactgtacaagttcatagattatttaaacttgcaaaatcaagaaacatacactctatatgaaattcccaatttcagaactgtagcatcatagtgcataactgagccataaataataccaacacagtgtatcattcaatgttatcattgtaagaaacaatggagaatatcaagccaatctattcaagctattgaactgaggcctacagatgttaagtaaatggttcaaggtcacacaactagcagagatggggagatggggttagaatcttcctgctttttccaatgcctataggatgacactgaaaattaaaaagaaaagataaatgagatctttcagacaaaagcacagacatataattcccacagactatctgtaattaaagggatctttaaaaatagctaatcaaattatctgtttgtgagaatcttaatgattgctattcaatttgcttaaattatctttattttctaaatcaccaaaaaaaaaaaaaattatgccatgggccatagaaaaacatatctcaacagttagaacttcatagactgtcatgtataaatcagcatttactaaatacttcactgaaaatgaaggagggatatgaatgctaatccattttgggacaatattactttaagaagtgcttacctaccaatgccaatctgagaaagaacaagaaaagtagtatgcctcaaatgaaaggtcaggcccaagatatcctgcccattagatgtaatagagtttatcttcccaattagaactaaaaaatatgatagtagcctgaatccataattcagatagccaagaagccatcaggattatattacttgggctgatttgtctttgttcctggtgactcaggtaaaaaaagaataacaacattctcctttaaaatatttagatatctggacatactttccattctataaaggaagagaaaaaattagaagatatggcaaaatatttctaaatgagatgatataagacaatatagaataggaactgaataaaaataaatacaatttgggaattccaattctaaaaatctaaataatgaaacaaagtttataatagtttatgtaactcaaatgattctctaaacaggctgatggcattaaatttatacattttaagagaaaaatgtcagtgatcaataatgacaaaaaaaatgtcttgcattaagagctttatgaccaccaaacctaagattaagtatgaagaagacccttgagtcaccattcacagaataaaagaaatgttaggtgaaaaaacaaaaggtaactaccatttctactttttaaaaaataatttcaacttttattttagattcaggggacacatgtgcaacttttattttagattcaggggatatattgtatgatgctgaggtttgggatacaatttatcccatcaccttgatactgaggatagtacccaatagtttttcaaccctccctaccccctctagtggtctccagtttctatcattgccatctttatgtccacaagtagccagtattaagttcccacttataagtgagaacatgcagtatttgatttgctgttcttccattaattcacttagaataatagcttctagctgcatctgttgttgcaaaggacacaatttcattcttttcatagctgcatagtattccatggtgcatatgtactacattttctttatccaatccaccactgattggcacttcaattgattccatgtctttgctattgtgaatagtgctgcaatgagcatgcaggtgcttgtgtctttttgatagaacaatttactttcttttggatttataccctgtaatgggaatgctgggtagaatggtagttctgttttaagttctttgagaaatctccaaactgctttccacagagactgaactaatttttacattcccaccaacagtgaataagcactctcttcactctataaaagatgccaacatttgtcattttttgactttttaataatagccattctgactggtgtgaaatggtttctctgtggttttgatttgcatttctctgacgattagtgatgttgagcattttttcatacacttgttggccacttgtatatcttcttttaagaagtgtctgttcacgtcttctgagtactttttaatgggattatttggtttttgcttgttgaattctttaaattccttatagattctgaatatttggcctttggtagatgcatagtttatgaatattttctcccattctatagtttgtttattgatagtttctcttgctgtgcagaagtgctttagtttaatgaaattaggtcccacttgtcaattttatctatttatttatttatttttgagacagtcacccaggctggagtgcagtcatgagatctctgctcgctgcaacctctgcctccagggttcaagcgattctcctgcctcagcctcctgagtagctgggattacaggcacatatcatcgtgcccagctaatttttgtaattttagtagagacagggttttgccacattggtcaggctggtctcaaacttctggcctcaagctatccacctgcttcggcctcccaaagtgctgggattacaggcatgagccactgcacctggcctcaatgtttctttctgttgcaattgcttttgaagtctctatcgtgaagtatttgcccagttctatgtccagaatggtgtttccaaggttttcctctaagattcttatagtttgagatcttacatttaaatcttcaatctaccttgagataatttttgtatatggtgaaaggttaaggtccagttccagtcttctgcatatggttatccagctatcctagcactatttattgaagagggagtcctttctccattgcttatttgttatcaattttgttgaataccagatggctataggtgtatggctttatttctgggttctctaacctgtttattggtctatgtgtctgtttttgtaccagtaccatgctgttttagttaatactgtagccttatggaatagtttgaaatctgctatcatgatgcctctggctttgctctttttgcttaggattgctttggctatttgagctctttttttaaattcaaaatgaattttagaatagttttttcctagttctgtgaaaaatgacattagtaatttgataggaatagtacggaatctgtagattgtaactagcacttttaaagcagtaattaccacatctaaaagactaaagtgagggccaggcgtggtagctcacaatcggcactttgggaggccaaggcgggcagatcacgaggtcaggagttgaagaccagcctgatcaacatggtgaaaccccgtctctactaaaaatacaaaaattggccaggcgtggtggtgggcatctgtaatcctagctactcaggaggcagaggcaggagaataacttgaatccaggaggcggaggttgcagtgagccacgattgtgccactgcactccagcctgggcgaaggagtgagactctgtctcaaaaaaaaaaaaaaagtgaaatgaaatgatacagatctgggaaaactaacttggatcattcacacaaagggaaaacagagacgagggggagataaaggaagagggtcattttttttctgtaggggaggacagaacatctgaatcatttggaggactcatcacactttaactctgtcactaaaccattaggatacctagctaaaatactggaaatagagattgttacggctacacactcttgcactctccataacatatactattacattatttgaaacagttttacttattaaaaaaatttagggttggcaaatctaaaactagaaagacaatcatgaatgacaaagataaaacattttagctaaataaggattctgaagtggttcatataagtgaccagggctcagaatagtgggagtcatgctaagtttacactcctagtaaacactcctatgttgggtgaatacaaggagacaccaaaaaaggtaaaggggtgttatcaagtggttttatcccattctctcccccaaagatacacatgactagcatggtcctgtcaatttttccattctcccagtgtgataggttgagtattttagagcatttctttcagcttacactctgcacgcaattatactcagcaacattcctaccaagtctaacttgtcagtgttgtcacctggtccctttccaaattcacctaagcccattggactcacagagacatgagaaaggtatcgtcaagacataattaacttcatcacatgtaactaaatacacacgattccgtccaaataagtggcacttacttatgtccatttaaggctgcgtggtgtaaagcagtgtaacccgaactgtctgtgcagttcacattggggcctcgccagatgctgcaaataaagcacaagcgcagagttaacagtgaagccagatcttgccttgaaaaacaaaaagaaggctggtagccccacagtcagcagcaggttgtagataaaaattttagccatgtggaaaatgattgccatcttctatgaattcccctcagaacatcaacttcatttatttgataaaaggaaactaatagagaatgcaactattaatatcttcagaaattattaacaaatgtgtgtccatggtcgtgcactgaagtttggatccaaaaattccctattactttctatcgttacttaaatattagaagcaactaacattcagctactatattccataccaaagaataaagatttatgagacctgcctcatgcctgttaacacactccttctgaggtgccggtgatttatataagttataagatatttttgcattgtgggaagaatataaagtctttttgctcttcaattgcaaccaggaaaatgtaatcaatatttcatacttgaaaataaaattgaagatttggactgttgtaaaccatgagaagatcctaacaattttgcagtcatcattgattttactatgcaatatattctggagataacatgtaactatataaaagagtctattttttttttgataactacaattaaggaaactctttttaacttttggaaaataaggcactgaaagacacttttccaaaaatagaacaaaaaattgctttatctgatggtcatagtgatatcaaaactatcaaagataaactagttcacacattcacaaaacatttattgtacaccaactgtatgtcacatattgagctaggcactgggagcacaaaatcgtaactcaaggtccttctttacaagaacatagtgtaatggaaaagatagacacacaagctaataattacaaagtggtaagataatcaaggtaccagacagcacacaggcatctctgaaaagagaatgaatagctattccaaacaaggggtcatggcagacttaaactaaggtgggtcaatgaaaatgaatggaatgtgcttatttgacagttaattaaaagaagaattaatgaaacacatggatcaattggaagaaggtgggaaactggaagcagtagtctagagatgactcagactttaggcttacatgactagaaaaaattacaatattaactaagatgtgaaataaaaaaagagcaaaatctgctgcagggaagacaatgcaggatggagagaaaacaatgactcctagtttgcagacgttaaatcttaagtctctgacttacttacattacataggttcaatgcaatccctatcaaaatcccaatggcattctttaggaaattgaaaaaaaattctaaaattcatatgaaaccataaaagaccccaaatagccaaaacaattctgagaaagaaaatcaaagttgtatgccaggctcagtgactcatgcctgtaatcccagcactttgggaggctgaggagggaggttcacttaagctcactagtttgagaccagccttggcaacataacaagactccatgtctgctaaaaataaagaataaaaaaaattagtcaggtgcggtggtgcacacttgtggtcccagctacccaggaggctgaggtagaagggttgcttcagcctgggaggtcgaggctgcagtgaaccataatcatgccactgcactccagcctgggcaacagagcaagaccctgccacccccacaacaaaaaaaagaaagaaagaaaaatggaggcatcacacatccagattccaaattcaggggatatatatacatacaataaaatattattcagccctaaaaaagaattatatctaaacattttctatgacatgaatgacccgggaagacattatgctaagtgaaataagccagacacaaaaagaaaaatattgcctgaaaatatacggaatctgaaaaaaaatcaaatatacagagatagagaacaaaagattggtagggggagtagaacgggggaaataaatatcagaggatacaaagtagcaaatatgtaggatgaacaagtgtagaggtctaaagtacaacatgaagactacaggtaccaaaattgcactgtatacgggatttcagctacgtgagtagattttagctgctcttgccacaaaaacaaaaaataaagggtaactctgtgagaggtggtcatttgtttcactgtagtaaacttttttttactatctatatgtatcccataacatgtgtataccacaaatatacacaataaaatttatttttttaaataccacaatgacatgctactatataactatcagaattgttatctttaaaaaggcttcacaaacctatattgacaaggatgtagatcaaccagaattcacacacacactgctaataggcatgcaaaatagtacaaccacttagtgaaacaatttggcagtttcttaaaaagttatatacaaataccacacataacttaccatcaaatcataccatacaaataacatacaaataccatataatccagtcattccactgtaggtatttagcccagagaaatgaaagcatatgtccataaaaagacttgtacatataatattaataacagctctataggtaatagcctaaaacagagacaacccaaatgtccattagctggtaaacagataaattgtgatatatccatacaatggaaataaaaagaattaaatactcagaaacaaaaggaattaaatactacgacattggttgaaaatctaaatcaattagattttctcaggaagaacagcagaatggctgcccttcaatctccccagcagaaagggagacattctctggcacagataaaatgcatgatctctggactagacccctgattggtagccttcatcaacttctgtgatgtaaatacttcaacttaacgcagtgataggaagagatgctaacaactgcacttcacaagcagacacaagccaatccagcacaccattcaaaggcctacaaccaacaagtcccaacactatgaactcagagcttcccatgagtttttgaaaacctccactctcaaatatgaacaaataaccaaagacatccaatcacttgaggaaagcctttactactaaagaaaccaaaacaaaaaattaggaacaaactacagaaaaaaaagaaacttagagaaaatttagactatgcatggagaagaaattttcaaaaacagttatcattaatatcatctcaatattagaaaagataatgaatgtaagaacaatgaaataaaaaagaaaatcagagataaaatcagtagaagaattaaaaataaagctgataaggccaggcatggtggttctcgcctgtaatcccagcactttgaaaggctgaagtgggcagattacctggtcaacatagtgaaactccatctctaccaaaaatacaaaaattagccaggtgtggtggcgcacgcctgtagtcccagctacttgggagggtgaggcaggagaatcgactgaacccaggaggcggaagttgaagtgagtcaagatcgcaccactgcactgcaacctgggtgacagaatgagactctgtctcaaaaataaaaagtaaaaaataaagctcatgaagtatctcagatacttagaaaaaaaaggcaaagatatagacaaatagaagggaaatcataagaaaagtaggacaccgatttagcagttccaatattgaaaaatagaggttcttaaagtcaaaacacagaaaacaggagaatgaaaacaatgaaagacatcattttaaaaattatcagaactgaaggacattaatttaccaaataaaatgtacatgggccagtcgcggtggctcacgcctgtaatcccagcactttaggagaccaaagtgggtggattacccgagtgaggtcaggagtttgagacaagcctggccgacaaggtgaagccttgtctctactaaaaatacaataattaggccgggcgcggtggctcacacctgtaatctcagcactttgggaggctgagtagggcggatcatgaggtcaggagatcgagaccatcctggctaacatggtgaaaccctgtctctactaaaaatacaaaaaaattagccaggcatggtagcgggtgcctgtagtcccagctactcgggaggctgaggcaggagaatggtgtgaacctgggaggcggagcttgcagtaagccgagatcgcaccactgcactccagactgggcgagagcgagactccgtctcaaaaacaaacaaacaaacaaaaaatacaataattagccaagcgtggtggtgcatgcctgtagtcccaactactcaggaggctgaggcaggagaaatgcttgaacctgggaggcagaggttgcagtgaggcgagatcacgccagtgcactccagcctgggcgacagagtgagattcggtctcaaaaaacaaaaacaaaaacaaaaaaggaccaggatagctttgataaaaaataaaaataaaaaaaagacaaagaaataactgaagtgagtccgatacggtcttttaaatttcaattaaacaaacaaaccaaattcctaaaacacccatccagggctattctcttaatttaaatttttcctctttcaactctagttacactaacaagtcttcactattcaggaaacctagaatgaagagaaattattcatacctattacttctacttcaatctgcaatcttcaattattaatggacactctccaagttctaagtccaagaaaatacaagtccaagaatcaaacaaaataatgaataagatatcatctcttcctccaaagagctgacaatctaatagagaaaaatatatacagataaattacaatataggcagtgaccatagttcctacagcacagaaaacacctaataattgtttgttatcaatcttcttgttcttattaaataaatgctacaatagaaaaatctttaactccctaaattaatacatctgttcaacaaaaatctctatggaatattttacggaaaactcaactaaaagttctaaatttgatttagaagaatttacgggaaaaaaaattgtgaaacaagaagtaataatgggatctacatactaccaattatgaaagcatatcataaaacaataccaaaaaatgttagtctagcaccagaatagagagctcaatgaatataagagaagccctagaaacaaaccagtcatacatataggaataaagctgacatctgaaagaagcaaaaaaaaaaaaaaaggaaaacatcattcaataaatagtcccgagaaatatgttttaattaatgggaaggaaaaaacaatttcaattccctaccccataccatttagcaaaatttaatccacatgatttgttcttgacttctcaaacctcattcctaccctctttttctcacacaccctgttcaaaccacacaggcctccttaaaaatataagtatgcttgcaccttatgactgttgcatttgaaattctctctgcctagaaagttttttcctcaatcatatggctcaatctttctgctcaaatgtcatctcttcggaaactctctccctaattattcagtcaaaaatagcaccctatcatcattctctttcctcttagttatgggacttatcaccatctggcattatattatttatttatatgcttactgtctgtctccccactagaatgaaagctccaccacactatctttgggtcttaaaacagtgactggaatattgtaggtgaccagtaaatatttgttaaatgaaatataaaaatgttgagtacatatatgaaaaatgtcaacctcactggcaatcaaagaaagcaaaaaaaaaaaaaaccaaacccataccattatatatttctttatcaaattgggaaaaaagtcaataatattcagtaatggttagcatgcagagcttataataagctggtggtgaaaatgtaaattggtacaatttttctggaaggcaatttgacattacatgtttaaaagctttcatagtgtgcaaatgtgttacctagaaattctccttaagaggaattattttaagaaattaattaatagtttgtacaaatatttagctataaaaatatttatcacagagtgagggtagtaaaaattatggattttgatatataatgccacttagaatagttattctctctttgctcttgtcagctagatttctaacactgcctgcctccagagcttagtactcatctttctctctagctttcttatatgagacccacagcatcagtgtcttatatggctccagtagcatatggcttgagctcctactgatcagggttttttttttttagcttatgtgaacctccctgggaggagaaagtctaccaacagagtagccagggatcctagagaggacgcaattcttcttagttttatacaatggctcaatatatgtgacagataaacagatatcactattctttaacataaaataaaaatctcacaacaaaatggaaaaacaggatattaacaggcaattcacagaaaaggaaatgtgaatggctaataaatatttgaaaatataattaacctcactgtggctagcaaagagcaaaataaaacagtggctgcctacttttctaccatcagatgggcacaaatttttaaagaaataattgataacaatcaatggaggcaaatatgtgaagaaatagtcactctcacagaatattcattgaagtgtaaattgctacaacattcttggaaagtaacatggcaatacataatcaaatttcaaatatgaatactcttagacccaacaactccacttttcaggattgatatctatgaaataaaaatattcatatgaagactgcagacacaaaaatatacactgtagaattttaatagtataaaagagaaagggtctggaatggtggctcatgcctattatctcagcactttgggtggctgaggcgggcggatcacctgaggtcaggagatcgagaccagcctgtccaacatggtgaaactctgtgtctactaaaaataccaaaaattagccaggggtagcggcgggtgcttgtaatcccagcactttgggaggccggggcaggtggattacttgaggtcaggagttcgaaaccagcctggccaacatggcaaaaaaaacactttactcaaaatacaaaaattagccaggcatggtggtgcatgcctgtaatcccagctactcaggaggctgaggcacaagaatcacttgaacccaggaggcagaggttgcagtgagccgagatcaggccactgtactccagcctggatgacagagagagactccatctttaaaaaaaaaagagagagagagagagagaaagctcataaatgcccagcaaaaaaaaaataaaaaattaattagtccaatagctgagaatggggcaaaaaaggaaaagttaattaggattcattcacactatgaaatgttatgcaactattaaaataaataactttgatctgaatgtattgactttgaaagtcagccaaaacatataaagtgaaaaacgtaaattgcagaatattgtgtgtgtctggagcattccaaatgctttatatgcattagcttatttatagccacacgactataagaaagttactattactattcccattgtatagatgaaaaatatttgcaataacatagaaaaatacatgcaaaaatacattattcattctgtgaatagtctgaatgttgaaattatcatgaatttctttaaggaaaagaaaagacaataaactacaaaggaagaaagataggtttgctccagattacgaagaacctcataatatattgaaaagcttggattttattctgcagcaacttggaactaaatggctttcagaaagataagtatgttcctcacatgatcagtcagtgttttagaataagagctcttgtaacaggtggaaggtaaacagagtgagagtcaggttaattgttttacagaccaggggagaaacaaagcaatttgaacaaatgcagatatagtggtagagagagagagggtgagaaaattcaaattgatatgtctaaaataaaacctatgggagatggtatccatatgaatagaataagaacaagagaatggctgaggtttcaaccatgaacgaaatgcatcaatgatgagatatctccactagaaaaagctgcaagggcagtagtatcttctggcaggagccaagtttcagttaaaactgattagaacactaggttgcttggagtacctcaggcaaaaaatggaaaagaaataggaaaatactgcaaattaactgtcatacattttttaaatttctgcatgttattagaccttacaaatattttgtaagagaagatatttataactaaaataagattcagggcctatagatttcaattacctataccaactcagttccccattatacaaaaattaattataatacacacatttttaataactccattgaatgtcgccttctcctagcaaaatggatatggatacatcttttttaaacaaggaggtttagaatggaaagttagcatatatctaaatatattcaactgcacctattgacagagcctctaggcacatatccacatatccatagaacatccaccgacacatctgaaacaccataaataagccagacccaaaccctccaactaaaaatttaatttaaaaaagaaaccttgatttctaaaaggttctgcttcattccaactttttatattgccttgccccctttactcaggcataatcttcaaatttagaaagagggcctagattaaaaacttgattaacttaagcttgtttcataaaatgcaagagtttctagacacatttaagaaatgtcttgaaaaagtataaaatgcttattacatatttattccaaaaaaagcaatttatagatccttggtcttagtctaatacacacccaaatcccatttcttatgcctacttgtcaatatcttaaattctgtatgtgagaattactgcccaaaatgaatgttctcagacaatatggggttgccaattaccaaaaatttaatttcctttgttatattatttgcactaatgtaacaaatcagattagtagattttagaataaatataaacaaaatagttttctaccaaactttcaaataaccaggacattcattagtcagaatattctattatctaagctttcacatattaaataagattattcttaaaccataagcctgagtttcttaggccaatatccatatgtacagcaaataagatttgaagcacaactactccacaaattgatcattattataccttccatcagtctatggggaaaatctatcagaaataacataaaactgtttcagtttttattgattcctatctgacccctgacacatgagatcacgccgaggcatcagatatggaaattcatacagaatgtgcatttaatgcctcaggcagggtcagagtatgtaggaatggtcttctgacagatcatatcatttcaagcaatgcaaaataaaccttattctcaatctgtgtcttaatagtttacttccatttttggatgaactggacatatgtacatatgctactgattactacaagtgaagttctcatcagtttagtgatggcacaattttattatcatgggctacaagtgtcccacatgggtcaaatgggtctatatcagcactgtcctttagaaatacaaggtgaggactgggcatggtggctcacacctgtaatcgcagcacttttggaggccaagacaggtggatcacttgagcccaggagtttgagatcagcctgggcaacaaggtgaaaccccatctctacaaaaaaaaaaaaaaaaaaacacaaaaagaaaaattagccaggcatggtggcatgcatctgtagtcccagctattcgggaagctgaggtgaggattgcttgagcctaggaggtggaggttgcagtgagctgacactgtgccactgcactccagcctggacaacagagcaagacccagtctcaaaaaataaaaagaaaaaaatatataatgtgagccatatatgtgaatttaaattttctagtagccacattaaaaagatgtgaaattagtttgaatatattttatttaacctagtatatcaaaaacattatttcaacatataatcaatataaaaagtattgagatgtttcacattcttttttgtactgttttcaatattggtgtttattttacacttatagcacatcacaattaggactagccacatttcaaatgcttaatatcctgatgtggacagtggctactatattgcacagcacagggcatttctatataattattccaaggggaaaaaagaaaattaactctaataatatgaaaaagctttctagtataaggaagagtagctaacggatgctggacttaatacctagaagatgggttgatctgtgttacaaaccaccatagcacacgtttacctatgtaacaaaactgcacatcctgcacatgtatcccagaacttaaaatattaataaaagttgatgaaaaataaataataaaaaagtattgtcacattggaacccacatactatcccatatgagtttattgaatgaatatttactgaaatgtgcaaaaccatctaagtaagatagatatacactataaagcttaaaaatgcagagaacaactatgaactggccttctgtgaagaatgagaacaagaatcagcaaactgtagaccatgagccacatccagtccactgtttgtttttgtaaataaagtttcatcgaaacacatacagacacatacacacacacacgcacaaaagctttctaaaaataactgcaaacgttggctttgtagtaaatacatgtctatttgagtcacaaacaatttcttaaagatatcttgcctttggagcaaaaataaataatagatctagtatacagtcatatcctagactgtaatgcacaattttacaaaaagcacatcaggagcatcatagtcaaaatcgtactaactaaacattttctgatgaataatgtgcaccttgaattacttgatgcaattctcaatacatgtatttttaccagcaaatgcgaattgaatgactatgagcaaaagtaactccttgagttataatcacacatataatacaattatgacctctcttcaatatatacagtatgtgccacaagatggaattttagaatatgaaaagaatttgtaaccacaccgagccataaacacagagtcaagagacatgagaggaaaactagagcatctattttaacctagttttaacttcatcacttgttctaaaagtgtaaaacattcctcccagcccatattttctcttctctgcatagatataattcctggaaaataaaccagcagacaaggcagattaatctctcattgtcacacgaacactgattttggtggcaattgtttttcctatcctcacattctcttcataggtaacaataattccagggtactatggtaggaaaaaataatggtacccccaagatgtatacgtcttaatctctggaacgtgtgcatattttgtattacacagcaagggagaattaaggttgcagatagacttacattgctaatcagctggctttatcccggattacccaggtgggccccatgtaattacaagtggagaagagggaaatggaagagtcagaatcaaaaagacggcacagtcaaaaagactcaactggccattgttggctctaaagatggaagagggtcatgaacctagaaacgtaagcagcctctagtagctggaaaaggcaagaaaacagattttcctagagccttcaggaaagaatgcagccctgcccacaccttgattttagcccagtgagaaccacagacctccaggactataggataacagatttgtgttattctaagccactacatttgtggtaacttgctacagcagcaatgggaaactaatacaggtgtgcttattgtaattaacacacccgaaatatgagacgttcagacctttccaaatacttgggaatttaaggtagcatgagaaagagagcatgaacaaaacattgactgcggacttgctacatactagaaactatgcaaaatgctttgtattgattacctaagttaatcttcataacaaccatgtgagacgggggcttttataacccctggatttttaaatgaagaactgaagagcagaaaagtaatttatcaaagatcacacagctagttcacattgcaggcaagatttggaaccaggctgcctgattccagagccaatgacattaaccactacattatacttcagtctcattgtttttatttacctttgattataataaagtggagacatttttacttgtataaatataaggggtccaagtgcagttttgttacagggatacattgcatagtggtgaattctgggcttttagtgtaatcatcacccaaataattacattgtaccttttaagtaacttttaatccctcaccgcccaaccccaaccctcccacctttcctagcctccaatgtctatcattccatcctctatgtccatgtgtacatattatttagctcccatttataagtgagaacatgtggtatttgactttctaagttctttcacttaagataatggcctccagctccatccaagttgccaaagacattatttcattctcttttacagctgtatagtatcccattgtgtatgtgcatatcacattttcttcatccaatcatctgttgatggacacttagattgattccatatctttgctattgtcaatagtgcaataaacatacaagtgcaagtatctttttgctacaattatttattttcatttggatagatacccagtcgtgggattcctggattaaatggtaattctttgagatatttccatgaagttttccaaagaggttatactaacttatattcccaccaatggtgtataagcattcctagaccttttatgtttcatgaccaatttcattttttctatgagtagcttgtttatattctttgcccagtttttgtattgagtttttcattatttttactgattttcatcattcttactgatttgaagaagccattttatatttatagatattaaccctttctaatgttgaaaatatttcccttatttcatctttcagccgaacttatggtgtactttgcctggccataatgtttactaaatcattctatctttctttaaatttattgtttctagccttggtaccattgaaagaaaggtcttcctgattacaagatgataacaatattctctagtatttcttcctatttctttttttgatgaaattttttaatttctctctattatgggtatatgatatgaggtatttcccaatggaataaactaattcaataccactttaaaataattaattgccatctaattaccccagtgaaatgcttcctttctcatatattatttttctgtacctgtatttcaaatctgtattttgactgttttgttacattcatctatcttctccaaagactaatattacattatttaatttctatagctttatagcatattttaatagctaaaaatagatctcttctgatatatatattcttaactgtttttatcatgggtttattcatctgtataatagatggtatagtcagaccaggcacagtagcatgtgcctatagtcccagttcctcagggggctgaggcaggaggatcacttgagcgtaggagtttcagtccagcctgggcaatacagcaatacctcatctttaaaataaaaaataataagtatagtcaaattgtcaaatttaaaaaaaagttttggctgtaattgcattaaacttatagaaaaagtaggaagaaatgagatctttgcaattctgtatttttccagctgaatctgatttccatctctacagctttggtaacagtcttaggcaaggtacttcacttcattagacctgagtttccccataggtaaaacccaaggataatcacagtaataacctcactgtattgtgagaagattaaagaaaaaatataagtattaaatatactacgcaatccacagaaggtacttattaaatgttatttaattggtctaacctttttatattttctttatagaactcttaaaaatattttaaaattattttctttaacatacttacatagtgaatactatgtgccagatatcattctaaatgttttctaaatattaactcaataaatcctcatagcaacgctatcaaatgagtactataattactacacttttcagattaaataactaaggtacagagtagtgaagtaccttggttcaggtcacatggcccctaccaggtgaagcagggattcaaaccacagcatgcctttaatcattatctattgccttgttattttaattcctaagtaatttagttctttattactattccacatgaagtcttatttttcatgtcttttaattactgctgctagttagaacactgtgtttttcaaattcattcactcattcaaaaaatagctattgagtatccactatatacaggcactgttctcattgttctagtcactgacaacacagcagttggagaaggctgtacagaaaaaagacaaaaattcctgccctcatggtctttacattctgatttagttagacaaacaatatacaaatgaatatataaatatatgaagcaagaagtggtatcaagaaaggcaagaggaacagagtgctgttttatgcagcatagtcgaggaagcctctgggataatagggcaactttggaagaacattttaggaagaaatgggcttaatgctgaggaacagccaggacagcagtgtggctggaatagggtaagcaaggaagagagcacagaaaagtgggtcagagatgtgtggctggatcatatagagccttgtggccattctgactttggccttgactgatatggaaagccatcggagagttttgaatggagaaatgacatgatctgacttgtattctgctgctctgctaagaatagtctgaaggggaaagggtagaagcaaggagatcagttaggaaattactatagtaatgcaggaaaagatgatgacggcttagagcaaaggggtagcatcatgtagagggaaaaaatgcttggattatgcatttaaaggtaaaggaaacagaatttgctgacaaattgtgacgtgcaaagaaaagaaacaggaaggactgcgagatttctgtcatgagcaactagaaaattggaattgccatttattaatttggataagtttgcagaagaggttctctattatttttaggtataataatcatgtatctcttcctttataatattcattccattttttctccttacacaaactgcattggctagaaccactaaaataataagaagataatctttgtcttgttgatgaatttaacggcatgcctggtagggcaccaccatttagtatgatgcttgctactggattctcatggataccttttcagcatattaaggaaacttttattccctcagtaaagaacaaaaaggtggaatagcataatggataaaagcacggactcaggattcaaactgtctggactaaaatgctgatcccctccctaactgcaccaccttgggaaaattacctaactactccgtgcctcagttctctcatctataaaatgaatataccagtaatagctagctcatagggttactgtaaagattaaattagatgtaaagtgctagcacaatgcctgacacataataatcatcctttctgtaggaaaagtttttatctagaatggctcttgtggtttgttaaatttatttaggatatctttcacgatggtcatacagcttttcccttttaatacattaacatatttaatgtcggatgagaagcatctctacactactggaagtaaatttatctacttatggtgtatttttttaatataatcctgaatttgatttgctctttgtaacaggattttgcattcacattcacatgtaaattgtctctggttttcttgtcttttttatttcagttttggaagcaggttacataaactgaagagtttggggccttttttctagtttccagaataattcaaccaacatagaaattgattatgttaattgaatatttgaaagagcaaatgtaaaatcatctaggattggcacttttgtggagtaaacccttaataaaattccagtgtcttctatggttactgacttactaatatagtcgactttttcttacattaattctgtcatttacatttctctaggaaataagttctttccatttaggctttctaatttattgactagaaatcatacatatttttaaatcggttgttattgtccatatttacagttctatcaccattgtaattcccagtgttctgtattatttttctctccttggttagtctaggtggggctagtttatcagcatattcagagatttagttagctttatttttatcaaatgtctattggatatgttatttattcattgtttatttactttttaattaactactctctgttcttaactataagaattcagttacctatttcacatttgagttgaatgcttcactcatttaattttattctttcttattcaaaggtaaaagcattataggctgtgacatttctacggaggttttgcccacatgacttaggttttgacgagttatttttcatttcaattattatatacacagcctgtaattcagtttttgtgtcctttttactctgaaaattatagttgttttttaaatttatcaatgcttagaatcattatatgtcttgctctatttctagtgttaccacattatagtcagaaaagaattcttcaacttctaataatttatttagaatttttttgaaaactagtatgtagtttttgttatgttacatgtgacaaaagttctttgattaaccaaattttagctggcctcctaaaacttctcctaggcccatctgtgtacttccttgtaaaatagcaagagctctgctcagtcagtttagcaagaacctccacccttgagatcttatcagattcctcatcctccaccatccctcaggtgatacctggtcaccatggcctgtcttcagctagacttttcgaagttggtttagccaaaaaccctcttacccatgtttcctcttggtaattttccatccactgacccctgccctgttccccggctatgaatttccacttgcccatgctatatttggcactgaccccaatctctctcccccactgcaaaatcccattgcagtggtccctatacctgtgatagtcctgaatattgtcttccttaccttgctttaacaagcatcattgaataatttttgttaatgcatgagcattgaaaagtatattctattttttagggagagatgtgtacttttcaagcttattaattgcataattcaaaccatcaataactatttagttcgtctacttcattcgcaaatttttggaaatgttaccatacacagtatatcactgtgattgaattattaccaaattttctttgtatttctaagtttgcttcatgtgttttgttgctgtagtttcttcagtttgtttgtttgtattaaggcttttttccaacttttaggttcaagggtagatatgcataacgtgcaggcttgttacacagggaaatgtgttcctacatcatttctgtcatttatgtttttctaggagataagttatttccatttaggttttctaatttgttgactagaaatcacacatatttttaaatctgttgttatcttctatatttacagctctattaccattgtaattcctaatgttctgtattatttttctctccttggttagcctaggtggggctagctgcacagatcatcccatcacctggctattaagcccagcatccattagctattcttcttgatgctctccctcctctcacccccaaccctccaacaggccctgtatgtgctgtccactccgtgtgtccatgggttctcatcatttgcctcccacttataagtgagaacatgtggtatttgattttctattcctgcattagtttgctgaggataatggcttccagatccatccatgtccctgcaaaggacatgatttttttcctttttatggctgcatagtattccacagtgtatatgtaccatattttctttatctagtctatcattgatgggcatttaggttgattccatgtctttgttttgtgaatgatgctgcaatgaacatacatgtgcatgtatctttataacagaataatatatattcctttaggtatatacccagtaataggattgctgggttgaatggtatttctgtctctaggtctttgagaaatcgccacactgtcttccacaatgttgaactaatttacacccccaccagcagtgtaaaagcattcctttttctccacaacctcgcatctgttgttttttaactttttaataacagtcattcttactggtgtgagatggtatctcatgtcgtttagatttgcatttctctaatgataggtgatgttgagctttttaaaagtttcttggccacatgtatgtcttattttgaaaagtgtctgttcatgtcctttgcccacttcttaatggggttgtttttttcttgtaaatttgttttaagttccttttagatgctggatattaggtgtttgtcagagagtagattgcaagaattttctcccattttgaaggttgtctgttcactctgatgatagtttcttttgctgtgcagaagctgtttaactcgatcctatttgtcaatttttgcttttgtggctattgcttttggaattttcatcatgaagtctttgtccatgcctatgtcctgaatgatattgcctaggttttcttccagggtttttctagttttaggctctacatttaagtctttaatatatcttgagttgatttttgtataaagtataaggaaggggtccagtttcaattttctgcatatagctagccagttctcccagcaccatttattaaatagggaatccttcccccattgcttttgtcaagtctgtcaaagaccagatggttgtaggtgtatgatgttatttctgggttctctattctgttccattggcctgtgtgtctgttttggtaccagtaccatgctgttttggttactatagtcttatagtacagtttgatgtcaggtagcatgatgcctccagctttgttctttttgcttaggattctctttgctatttgggctcttttttggttccttgtgaattttaaaatagttttttctaattctatgaagaatgtcaatggtagtttaataggaatggcattgaatctataaactgctttgggcagtatggccattttcatattaattcttcctttccatgagcatgaaatgtttttccatttgtttgtgtcatctctggtttctttgagcaggggtttgtagttctttttaaagaggtccttcacttcccttgttagctgtattcctaggtattttattctttttgtggcaattgtgaatgtgagttcattcataatttggctctcggcttgcctcttattgctgtataggaatgctaactatttttgcacaatgattttgcatcctgagactgctgaagttacttatcagcttaagaagcttttgggctgagatgtggggttttctacatataggatcacgttatctgcaaacaaagatagattgacttcctctcttcctatttgaatacctttatttctttcttttgccggattgccctggccagaacttccaatacttgaataggagtggtgagagagagcatctttgtcttgtgctggtttccaaggggaattcttccagcttttgctcactcagtataatattggctgtgggtttgtcttatatggctcttattattttgaggtatgttctttcaatacctagtttactgagagtttgtaatatgaagggatgctgaattttagcaaaggccttttctacatctattgagataatcatgtggtttctttacttctgattatgtaatgacttagtttattgatgtgtttatgttgaaccagccttgcatcccagggatgaagctgagttgatcgtggtagataagctttttgatgtgctgctggattcagttttctggtaatttgttgagaatttttgcagtgatgctcatcaaggatattggcctgaagttttctttttttgttgtatctctgccaggttttggtatcacaatgttgctggcctcatagaacgaggtagggaggagtacttccttttcgatttttttggaatagtttcaataggaataacaccaactcttctttgtatctctggtagaattcagatgtgaaactgtgtggtcctgggttttggttggtggctatttattactgcctcaatttcagaacaatattggtctctttaagtttttcagttaagcaaaagaatggcacatcatctttatgaattaaatgttttattattattttaaaaaattgactttgttccatatattgctctttaccttgaattatgccttgttattaatattactacatctgctctccttttgtttaacttaactagtagagttttgcctatccatttattttccttctatttctgtcattttatcttggctttatctcttgaaaatggcctatagctacagtttgcttttttgttttataatctgagcagctttgccttttaattcactaacatttgttattattcctgctgctaaattgtatgtaatgtttttattctcctttcctattcttttccctcctcttctctcttctctgttttcttgatcaagcgttcttcatttctttattcctttctagctatttttccttaacattttattcctaatagtcctttactttttgcaaatatattaaacctacatttcttactgacatcaataattacattgtaactatgtccatctttaacaaaacataacttgcatcttttcccacttttaacccaaggatttttgataaaacaaggtagaattttaatgctatagtgttactatttcctcttttatttcagaaatactttaataattatgttgtatttgacaaccatgttttcaatagcgacttaggtttactaatttcattgctcaccatagtttcttgaatatttaaaaagattatatgagatactgtgatattttgctgccttcaggttaccaaaaggcacagaatttacaaacatagtgccatgaccactaaagtcctatatactggaatatgattcatccaccccagagttgcaagcagtctttaggagatataaagatatgagaaatcttttgagagatatgaaaaaaggattagaactatgatgtggtcacattttgcggaatgcagtctttgtgtagacaggttatctgttctcctcccctcccataggtgtagaagaaaaaaacactcaactgggtttccttcccaaagttcacagaaagaagaaccaagaaaaacttgaagtgtgttgctgggcctcagaaagcaacaccctaaattatgatgttttggcacgctaagtactttgaactgaaggacagtggcagggcctcagaagcaaggtctctctcttttttctttcttttttttttttctttgagacagggtctcatcatgtcacccagtacacagtgcaatggcaatcatggctcactgcattctcaaactcctaggttcaaatgatcctcccacctcatcctcctgagtagctgggacaacaggtgcatgccaccatacttggttggaaatccttctgtccttctgagcttctttctcctgctcccctttcttccccaaggcaggccataaaaaatagaattcctcttccccaaggcaagtcatataaactagaaatattactctaaccttctccgacctttctgtgtacaacctggccatcaagaaattctctaacctactgtctgatagtaggtcataagaccctcattctagaaggagtcctgccctacacccagaaggaacaaatgcctcacagagaggtcaagaagaacctcaactgacaggccttgctgggtttccccactcagtctattaccattaagtcattccctttttgtctaatcacattcctatgtggccgtccattctcatcaaacctaaaaataaaaatgaacagttttcccttgggtctttacttctgaatgctcctgtgacatataaaactttgattaaataaatctgttattcttttttcttgttaacctatctttagttgtaggagtgttgaccctgacccttaagatgggttaggaaaggtatcacacccttctgcccctacagttgctgcatgaaggaataaccgacaaattcagtccatggttgaactttccctttgcttgacctaccccaaagcttaaggcagagtgggagtagaggaagagggacagggaaacattagactgaaatgacaaattgttcctggtgaaaaagaacagtttctagaatgtatggaacatgggtcctgcccagacccagggaagcctgaattggggcagcaaatggtgaatgagactgagagccacagtctggccatcaatcagtgcagcaggaggtaaacaagcaggagaggaagagagcctgaggctgactgcatggtgtgatagcatctatttgtgggaggctattgacaaacctgctttggagtaatgctgaagagaaaagggtcaaaaatactgtgggcagtcacagtgtatgaggcatcagttttcagtttcctccttgtccctcctccctgcaaagtggaagaatgggggccagggacagagggaacaggaaggggaggaaatagagagaaagaacagaccatgtattccctaccattctctaccataccaagttgcttttgcaaagagaaaaagcattaaatgaaatatgagatgaagttttcaagtggacaggaccaacaaagctggaagacttaaagtaccatatatcacgataatgtaaaagaacaactggcacagggatacataaatagatctatggaactgaatagaacccagaaacagaccctaatctatatagtcccttgatttatgacaaggatgacatggaagtgaggcacttcttattaaatgacgctgagtcaatttcatatctatatacaagaaatgaatctcaacccataccctgagccatatataaaaataaattctagacagattacaagcctaaatattaaagggcaaaacaataaaatttctagaagaaaaaaatttaaaggcacacagcccaataaaaaatgagcaacgtcaatggtggattgcatttaaaaaaaaaatgtggtacaatacaccatggaatactacacagccataaaaagaacaaaatcatgtcctttgcaacaatttggatgcagctggaagccactatcataagcaaactaacacagaaacagaaaaccaaataacacatgttctcacttgtaagtggagctaaacactgggtatacatgcacataaagatgggaataatagatactgggaaataaagagggggaaaggatgaagtgagacaagggttgacaaactacctattaggtgctatgctcactacctggatgatggattcattcatatcccaaacctcagaatcatgcaatatatctgcatatgtattccctgaatctaaaataacagttgaaaaaaacaaataagcaaatatttggacagatatttcaaaaagaatattcaaataccaaatatatatatgtgtgtgtgtatacatatatgtatatacacatatacacatagttgttcaacttccttagttgtcaggaaaaatgcaaattactatcacagtgagacaccactacatatccaccagaatgactgaaatcaaagacagatgaaaccaaatgttgctggggatatgaattctcataccctgctagtaaaatataaattggtgcaaacactggaaagttacttagtagtacttattaaaccttcaaatttgcatactctgtgaccagcaattcagaaattcttacctatgttcactaaaaaacatgtacaagcatgtacagcactgttcataatagtgcaaaactgtccatcaatagtagaaagaataaactgtagtacattcacaaagaatactacacagcaatgaaaagcaacaaaactattattactctccacacaaaaatgtgtcttacaaacataaaattgaacaaaagaagtcatatagaaaataacacatactgaatgattccatctgaacaagttgaaaaacgaaaacaggacagtaattacccttctgggggatagtaactagaacagggcacaactggggtttctgagatgctagcaatattctatttcttaatttggattctggatacatagatgtaatgacttcgtgaaaatacattgtgctgtaaacttatgatttacatacctctctgtgggtttatttaaacaaaatgacaaaaactaagtcttaatagctggaatgtgactgttttaataacagaaagtgaaaaattatagaattggatttagatgtcattagggagcatgttattcagcaggaatggagatttcattagataacagtggtaacagaaattggaaaaatacaattgttttatgtttattccttatgatctaagaattttcagtcatttcagttatattaatctttccttttcttgaaattgatgtgattcaaaacatgttatcccaaaatatggtatcttcgcatttgagaaaacagcagaagcaagaaagtctctctctctctctctctctctctctctctctctctcacctactctcccctttcttccctgaagcaggccacaaagcctagctgaccttatttattatttagttattagttatttatttttataaactcttttctcttaaatttaatctcttagtaacttgaaacttccatcctcttgctatagccttcattttatacatacagcttcaaagtaacccaaattctctatcttctaaaccaatttccaatgcacaaaacacatcaataattctaggtttctacaaatatatgatagctatttttgtcttccatttttatccctacaaactagttagatgcattttataatcccaagcagaaataccccaattatgttaagtgactcaagggatagagttaattttgtatgaaaagattaaatttgcttgattgctcttttttagtgaagactatgttaatgtcaagtttaagagtgatagtattttgcttttgacaaagacataagggaaaattcttctcagctagttcagtatactctaaatcagccacaaatataaatcctaactcaagtttctcacaactagaagaaatcagaagaatatgataaaaatcaaagaattcatatcatgaaaatgaaaggtacaagagaaattcaataacatgctcttcctattttttgtttgacttaccataaaaatctgcactaatgggggacatctatgttttcaattctaagcataagttttagatctccataacatgaaaatgaccacagattctgaatgagtagctgctctccaccaccatatttccaagctctagaaactcagtgctagagctaaactgagttgttgctattgttttatttagaccacttgaaaccctgaaaatcatcaaaatgcagaaaatcactatgttggttaggtttcctgtggcaggaatatttaaaacaatttaagaaaactcctaaccagaacatgttcagagaattattaacatttttattcagaagtttagatgccattttctgcctcatactccctcattccctccagttcaactcttcctaattaagttttctggccttgccctacccccacctgatcatcatgataaaactaggacataagtattaatacttattaaagcattacaagtattaatatgtctactgttccatttcatggatctactcctactaatgaaggaggagatactaaaaatctaaataagaaattgcttttaaccttgaaaatttagaacattacattatgatatccttgaggttatttgaggaaaaatattatttagtaaactggaaggagtgaaattttttttctaaaggtgtcacaaagaagcaagtaatattggtaataacaattttaataatgtactatctcttataatgaaagatgatgttggtaacccagacaagctaatgggcatatgtttcacactggggtaatacttcactaccagtcacaggaacaaaaagccttttgcaaaactatgtgacaaaattaactatgcagtatgtatcaaagaatactgtggtggttttcaaactatgctattcagaacccttcagagatttagggtaaagcagagtcacattttgaggtgttctgcttcattcggattgatatcttcattcatttatgcatacaataaatacttattaagctatctattacatgcatgcctgtggttgactagcactttctggtatcacacctgtaatatgatagaaacagtccctgctctcagaaagctcagtctagctaaaaataaacacatcaagcaaataatggtagaagtaattaattaatggtcaaaggtacaaacacaatagaaacatgtatagagtgctataaaagaagtctttggtaagtttccttcaccttacgggttttctcataagattttagctgaataaagggtacatgcttccaagtgaccaaaataatgtaagctaacctgacacttatggtattaattaccaaatctaagctctgatgccctattttattgtgtcactttgattcaaaagaaccatacattcaaacgttaaggtatcttaagaatctctgtataccagatactatgttagaagctttagggctataaatatgcattcacttaagaaaatatttcaaaatattggattgaatatttactatgctaggcactggggattaacatttccatgtaataattagtttccagcatttctcagaaaatgtatgtttttccaaatcccaagaaaaatcagtcaagaaatagagaaaaacaggagaaaaaatggcggataggaggtaggactaacttgcagctcccactcggatgtacagagcagcatgtggagactcacactgtgaacttttgctccaagaactaccataggaacatatcaggaaagccaagagaatgcacagaccctttgaagaaggtggattggcaccgcaggctgtgtgggacagcagaggaactgtaagtctactcgctttctcagctgggaggcttgtagcctgaggcaagttctccactctgctcaacggctgcctgaaaataaactcggttctattgggagggcacagtgtgagtgagactggcctttcaggctgtgagttgcgggggagctgggtgaggcctgtggctgccagctttcctccacttccctggcaacctgtgtgagcagcagaggcagccataatccccctgggaacataactccattggcctgggaaccaaactcctttcccccatagcagccacagcaagccacgcacaaggagtctgagctcatacacgcctatatctgccccaacctggtggtgtttctctacccacactggtagctaaaaaaaaggacaatctcttaggagcgctatggccccacccactcccagaccctagggcaagcttgtatcctacctatactactggagctgatgcgctcttgaaagtgccacctcctggtttttggagggcaaccaacacaaaaccagggcacttaaaaatacaaccaaggacccccatagagtccgctttgctcccctgctacacccacaagagcaggtgctggtattcacagctgagagacttgaaaacagatcacatcacaggactcttcgtagacactccccagtaccagcccagagcctggtagctctgctaggagactagattcagaagagaaataaccctcactgcagtttggctctcaggaatccccatcactaggggaagggggagagcaccacatcaagggagcaccctgtggtacaaaaaaatctgaacagcagccccttagtgtcccagatcctccctctgacgtagcttacccagaaaaacaatcctggtaatatggcaaaacaaagttctttaacacccccaaaagttcacactagctcaccagcaatggatccaaaccaagaagaaatctctgaattgtcagaaaaagaattcagaaggtcaattattaaggtaattaaggaggcaccagagaaaggtgatgtccaactaaaagaaataaaaaaaagatacaggatatgaatggaaaaatctccaatgaaataaatagcataaataaaaaacagtcaaaaacttctgaaaatgaaggacacgcttagagaaatgcaaaatgcaccggaaagaatcagcaacagaattgaacaagtagaaaaaaaaaacttcagagctcaaagacaagttttttgtttgtttgttttgttttgttttgttttgagacggagtctcgctctgtcgcccaggatggtgtgcagtggtgcgatctcggctcatgtgcaagctccgcctcctgggttcacgccattctcctgcctcagcctcccgagtagctgggactacaggtgcccaccaccgcgcccagctaatttttttgtatctttagtagagacggggtttcactgtgttagccaggatggcctcgatctcctgacctcatgatccacccatctcggcctcccaaagtgctgggattacaggtgggagccaccactcccggccaagacaaggtttttgaattaacccaatccaacaaagacagagagaaaagaatttttaaaaaggaacaaagcctccaataattttgggattatgttaaccaaacctacgaataattggtgttcccaaggaagaagagaaatctaaaagtttggaaaacatattagatagaaaaattgagaaaaatttccccagcctttctagagatctagacatctaaatacaggaagctcaaagaacacctgggaaattcatcgcaaaaagatcatcacgtaggtacacagtcctcagtttatctaaagtcaagacaaagaaaagaatcttaagagctgtgaggcaaaagcatcaggtaatctataaaggaaaacctatcagattaacatagatttctcagcagaaaccctataagctagaagagactggggttctatctttagcctccttaatcaaaacaattaacagccaagaattttgcatccagcaaaagtaagcttcataaatgaaggaaagatacagtctctttcagaaaaacaaacactgagagaattcaccactaccaagccagcactaaaagaagtgctaaaaggagctctaaatcttgaaacaaatcctctaaatacaccaaaatagaatctccttaaagcataaatctcacagaacctataaaacaataatacaattgaaaaaaaaacccaggtattcaggcaacaaatagcatgatgaataaaatagtacctcacatctcgatactaacattgaatgtaagtggcctaaatgttccacttaaaagatacagaattgcagaatggataagaattcaacaataaagtatctgctgtcttcaagagactcacctgacacataaggactcacataaacttaaggtgaaggggtagaaaaagatattccatgccaatggacaccaaaagtgaacaggagtaactaatatatattcttatattcaatatatattcttatattgcaacagcagtttaaaaacacaaaaagggacattatatattgataaaagaactagtccaacaggaaaacatcacaatcctaaatatatatgcacctaacactggagatcccaaatttatgaaaccattactactagacctaagaaatgagatagacagcaagtcaataacagtgggaaacttcaacactccactgacagcactagacaaaccattaagacaaaaagtcaacaaataaacaatggccttaaactataccctaaaacaaacggacttaacagatatttacagaacattctatgcaacaactgcaaaatatacattctattcatcagcacatggaacattctccaagataggccatatgatagaccacaaaacaagtctcaacaaatttaagaaaactgaaattatagcaagtactctctcaaaccacagtgaaataaaatggaaaatcaactccaaaaggaaccctcaaaaccatggaaatacatggaaattaaataacctgctcctgaatgatcattgtgtcaacaatgaaatcaagatggaaatttaacagttctttgaactgaatgataacagtgacacaacctatcaaaacctctgggatacagcaaaggcagtgctaagaggaaagttcatagcattaaatacctacatcaaaaagtctaaaggagcacaaatagacaatctaaggtcataccttaaggagctagagaaacaagaagcaaccaaaccaaacccagcagaagaaaggaaataaccaaggtcagagcagaactaaatgaaatggaaacaaaacaaaataaaaaatacaaaagataaatgagacaaaaagctggttctttgaaaagataaataaaattaatagaccattagcaagattaatcaagaagagagaagatccaaataagctaagttagaaatgaaatgggagatattacaactgataccacagaaatacaaaagatcatccaaggctactatgaacacctttatgcacataacatagaaaacctagtggacatggataaattcctggaaatatacagccctcctacattaaaccaagaagtagaaactctgaagagaccaataacaagcagtgagattgaaatgctaatttaaaagttaccaaaaaaaaagtccaggaccaatcagacatttaaagaattggtaccaatactactgacattattccaaaagagagaaaaagagggaatcctccataaatcattctatgaagccactatcaccctaacaccaaaaccagaaaaggaagtaacaaaaaaagaaaactacagaccaataaccctgatgaacacggacacaaaaatctgtaacaaaatactagcaaaccaaatccaaaagcatatcaaaaagataatccaccacaatcaagtgggtttcatacgagggatgcggggacggtttaacatatacaagtaaagaaatgtgacacaacacataaacagaattaaaaacaaaaatcacatgatcatctcaatagacacagaaaaagcatttgacaaattccaacatcactttatgactgaaaccctcaacaaaattggcgtaaaagggacataccttaaagtaatgaaagccatctattacaaacccacagccaacattatactgaacaggaaaatgttgaaagcattactgctaagaactggaacatgacaaggatgcccactctcaacacttctattcaacatagtattggaagtcctagccagagcaatcaaacaagagaaagaaataaaggggatccaaattggtaaagaggaagtcaaactgtcactgtttgctgaagacatgattgtatacctagaaaaccttaagactaatctagaaagctcctagaactggtaaatgaattcagcaaagtttctggatacaaaattaatgtacacaaatcagtagccctgctatacatcaacagtttccaagctgagaatcaaatcaagaactcaagcccttttacaatagctgcaaaaaaaataaaataaaatatttaggaatatatctaaccaaggaggtgaaagacttctacaaggaaaactacaaaacactgctgaaagaaatcatagacaacacaaacaaatggaaacatatcccatggtcatggatgggtagaatcaatattgtgaaaatgaccatacggccaatagcaatctacaaattcagtacaattcccatcaaaataccaccatcattcttcacagaactaaaagaaaatcctaaaattaacgtggaaccaaaaaagagcccacataaccaaagcaggactaagcaaaaagaacatacctggaggcatcacattacccaacctcaaactatactaaaaggcaatagtcaccaaaacaacatagtactggtataaaaataggtatataagccaatggaacagaatagagaacccagaaatacacccaaatacttacagccaactgatcttcaacaaatcaaaccaaaacataaataggagaaaagacaccttattcaacaaatggtgccgggataattgactagccacatgtaggagaatgaaactggatccttgtctctcaccttacacaaaaataagctcaagatggatcaaagacttatatctaacatctgaaaccataaaaattctagaagacacattggaaaaacccttctagacatcagcttaggcaaagctttcatgaccaagaacccaaaagcaaacacaacaaaacaaagacaaatagatgggacttaattaaaccaaaaagcttctgcacagcaaaaaagataatcatcagagaaaagtgacaacccacagagtgggagacaatcttcacaatctatacatccaacaaaggaccaatatccaaaatttacaaggaactcaagcaaatcagcaagaaaaaaacaaataatcccatcaaaaagtgggctaaggacataaacagacaattctcaaaagaagatatacaaatggccaacaaacatacaaaaaaatgctcaacatcactaatgaccagagaaatgcaaatcaataccaccttactcctgcaagaatggccataatcaaaaaatcaaaaaaataatagatggtggtgtggatgtggtaaaaatggaacacttttacactgttggtgggaatgtaaactagtacaagcactatggaaaacagtatggagattccttgaagaactaaaagtagctccaccatttgatccaggagtccaactcctgggtatctacccagagaaaaagaagtcattatacgaaaaagatacttgcacactgatgtttatagcagcacaatttgcagttgcaaaaatatagaattagctcaaatgcccatcagtcaacaagtggataaagaaaatgtggtaaatatatataccacggaatactactcagcaataaaagggaacaaaataatggcattcacagcaacctgaatggagttggagaccattattttaagtgaagtaactcaggaatgaaaaaccagacactatatgttctcattcataagtgggagctaagctatgaggaaacaaaggcctaagaatgatacaatggactttgggaactcggggaaagagggggcgggtgagggatataagactacacactgggtacagcgtacactcctccagtggtgggtgcgccaaaatctcagaaatctccactgaagaacttattcatgcacataaataaataaataataaaagaaatagggaaaaccagaaccagtaaaagtactataattctcttgtgaggattgaagcttaataacatggagacattactggttcaaaggaatatactgatgtaaagttgaaagcaagagcagataatattgacacatggagtagaacactgaagttccagtaaccaaggaaggtgaacataggagagaagttgtcacatttaatcagttagtcttattgtggctgttgcagagttatatgtgagtattcatggcattgcatgctgctaacagtgaagaactcttgcaagtaaaataaacattaacaagtttacacgcataatatactttatgcaaatccactgagtggtgttccaagaaatgacaagttttggaagcaaagtaagcccttacattgacaagtttgacatataattctttgaggtactgttagctttgctaggagatctgaatgttatgtaattcaaatactacccaatcacttttgactggtgttttctagtgtctgaatattcactacaggctacagttctctataactattattaaacttcatatttctcatatattaaacaaaatgttagatatttaaaataatgagcaaagcatataaaaactgttgaaagttttttgttttgtttttgtttttttttttgagacagagtcttgctctgtcacccaggctggagtgcagtggcacaatctcggctcactgcaacctctgcctcccaggttcaagcgattctcctgcctcagcctcctgagtagctgggattagaggtacctgccaccacgcctggctaatttttatatgttttagtagatacagggtttcatcatgttggccaggctggtcttgaactcctgacctcagatgaactgcctaccttggcctcccaaagtgctgggattacaggcatgggccaccgcgcccggccgaaagtatttttaaaacaacttacaatttcaggaattcccagaaattctcaagaattactacttctcatttctgaatcccaaagattaatatttattgggaattgggaaatactacttgagataaaagttgactaagagaacttccctgcctctttgaagtttaggagagagatgaaaacatggaaaccaaaaaaagtattaaaggtgttaagataaaattctatttaggacacagtgaagacacaaaggcaaaagacacagagcaattatgcccacagaggtctggagaaggctttacagcaaagaacatgagatcttgagtggtgtcctaaaaggcaaaaactaccttctagataaaataaagggagatatgagactgctaacaggccatacagagggaagactgctgaggctggggtcatgaaacatcatgggttgttcagcaaacatttagtagtttagggaggaaggtggagtttgatgggagacaggaagaacagaaagggatttaattcagggaagatcttctaatgaaaggaaaagtctcccaagaatcttaagtagttgactgacatgatcagatttatattttttagaaagatccctctggaggacacatggaggatgggttcaaagtgtgtgagactagagattagtactgcaacagttaggtgcatccctaaacaatacaactccatacattgttaaagacccacacatacccaacacactgcagggtagaaacctgtaagaggaattgggaatgaaagtgaatactaagtctaatgggtaaaataacaagattttaaaacagagagtaaggcagtcatgatgcttgttgattgtatcatgaactgaagagtataataaactcaagccactgtagctgaggtacctaggaacaaacaaatgaaaggatggctatatctttcctactgataaattaaactacatttgccccaaggctgcctccatactttgagtcctatgtaaagaactacaacccaaattagtacataaactcaggaaaagctaattagaagtatacttttgtaacaaatatctgagtctcagccaatcacagcagctgagctttagtctatcacaagcagccaactgatcagaccatgttcaaataaggcaaatgcctagctaaaataaatcaggctgttcctgtacctcgcttctgtgttctgtccataaatgcagcttgcccaggtctcagagcagaaccctctgaacctcttctggttctgagggctgcacaattataatgcaaatcattctttgctcaaattaactgttaaatgtaatttgtctaaagtttttcttttaacactattcttttcatataatcacatgaaataagagaagaaaatcaatggtagaaaaattcccttgtacagtaaatcaaattgttaagaagtgtaatttctttaaaaagatatatctagttactctatcactgactctcaaataatctgtagaactttattcattttctaaagagtcttgttaccctcatgatccgtatcaacctgcaattcaaaatatcatagaattgatagaattgttttgtctatcagtaattgtcttcatggttatatttttttcagattatatttgggaaaagctacttattagaggaatatctacgaataataatcagtctttcacaagcccaaaagctctgatatctccctccctcatgatcccattgctgttgatagtgttatgcagattttgtaaacaattaaatctgttcgcatgcaaacaattttggtttaaccatgaacaacaataaagaagttcatatacttcttttatgtaattcacgatctacccatgctccttttaaaagcatactaatatatcctattatgtattccaaagctgttatacgaaagtgaatgttcttttcaaaattctttttgacatgccactggagcagctccagaaaaaaattaacacttttggggaattttattgcatccctttcagtagccaaaaaggaagcgggtggggcgggggtggggggctgaagccaaagattaaaataaatgcataattcatttttaacatggtaggttttctctcattcttcattgtaatagctctagaactaattttactgttaacactgaatttttagaggggtgttgtataaaccattttttacaaagaaggagactaaaaagattttctgctcaccatcagtgcacaaaattgaacaagtgaaaatcttcacacacaatatgcttccaatgagcatgctcttatgcatcaaagaggaaacaaagcatttcaggattatgtttgtaaaaggattgtttttgaaaaaaataaaaaagcatagagcaaatttcagagtggaaaaacatcaaaggcttttcaatagtcaaactcatcactagatttaaggcaacatttaaagcaagacatctgtgttatttatataatatcaaaaagaaaaagcacaaaggtagactcaagacaaataaagaatccacctcctatgctataaaatacttcttatgtttgtctctctaacagtatgctattattctagcaaggcaaatatgttcttaaaagggtatcatgttttgtatgatgctgatgagcgcagctttttcatgtgtcttgcttaatgcagctaaatactacgaatgctattcagttatcaaagatacaaagaaccattcaagtttaggaaattactagactctttcttacagaaacacaaattattataatgtattgttttcatcttcctgcccaatatccaaactttataatccattctatttttctctcacattgtaccatgagacacttttactgcgagcagtaagtatgagaatgcaaaatctagggaggggtgaaaagaagtaaaagaacaacaatgtaaaggaggggaagctgacatggagaaggaaaaataggattcaacactcttggattcagttattaattcttaacaaatgtccccagggagctcacccagtatttctagaccagatggaaaaaacagtatgctacagcaactctatccctagacccagctgtcatgaggaatagagaggcaatcccagtaaggaactaacatctaacaccatacttcatgtgtgctgcgccattcatatacaggctgaccttaagatggtgactgttttgtttgttggttggtttttgttttgttttgctggcttcttatgtatgtgcctctgttttttatatcaatccttgacctctctccaaagtccaatcatgcatttccaggccctgccaatgatctcctttgtacctttaagtcaacattccccaaaaccattcattttctcctaaacctgaaaaaaagaaaaaaactccaccacttgactttttccctgtggctggcaacaccattctctcaatccttcaagcattacattttaaaatgataactgagttttccttctctctcttcatcatatcaagatcttgctggccaggcacagtggcccacacccgtaatcccagcactttgggaggccaaggcaggtggatcacgaagtcaggagattgagaccatcctggctaacacggtgaaatcccatttctactaagaatacaaaaaattagccgggcgtggtggcacacacctgtagtcccagctactcaagaggctgaggcaagagaattgcttgaacccaggagacagaggttgcagtgagccaagattgcaccactgcactccagcctgggtgacagagcaagacaccgtctcaaaaaaataaaaaaaaaaattcttgccaaattatatagcctaatagcaaaatatttgtcaaaagtcgatccccttggccaagcgtggtggctcacgcctgtaatcccagcactttgggatgccgaggctggaggatcacaaggtcaggagatagaaactatcctggccaacatagtgaaactccttctctactaaaatacagaaattagctgggcgtggtggcacatgcctatcatcccagctattcaggaggctgaggcaggagaatcacttgaaccagggagtcagaggttgagttggaggttgcagtgagccgagatcacgccagagcactccagcctggcaacagagcgagactacatctcaaaaaaaaaaaaaaaaaaaaaagtagaacccctcttttccaattttgttatgtaattccatcccaaagtttggattacccaggcctctcacttaaatggtcacaaacacctaactggtctccccaccttcaatctctttatccccaattcattatatccactgctattaaattaatattcctatggcacaactgtgatcctcctcctccaattctcaaaaatctttagtgaattcacaattattgaaaatatttaaaatcttttagccatgaaaatcaaaggttttcatgatctcacctcaatctcacttttcaaaatgatctcacacaatctccttcatatactccatgtttgaaccactggactacatattattaagtgaaatgtacctgagcttgcacatcttgtgtctttattcacactaatcttccctccttgtttgctgtgatagggactgtgctagatagtatgatacaaagatgaataatagatcttatataggttctaagcttcttagagaagcatgagctttggaattagataggactggggtctgaattcagattctgcaattgccagctgtctgatttggggcaagctcttaacctgagagacagctttttgagctgtgaaatgatataataacatctaccttggaaagttgccaggatataaattacatattttaaaagcatgatatggtgtcttccatttaggtaagtcttccttctgaaataccaacattagcttccccaagcagaatgcactgatgacaataatgagttagctgtcacctgcaaagatcctgagttagtacagacagagaacaattgcagctttcctctactccttttcttccttgcagagacaaatgagggtgacctcacagtttatgcctcgtaacgtttgcctagtgatcttttccattctccaacaccatccaggcaataagcatcaatgttaatgagctgctggacagctttgtgaaactgactgaaagagccagataggtattggtgtcctacacatgcaaataatatactttcccttcaaatgtactatttttatataagtttcaaaagttacatcctggtggaatgacagtacccaactgaaatatgttttccactctatgttactgcttacttcaacgggaaaagaatatatttacactttgccatattatgtaaacatggaaaactgagctaactagtgtcatgttattaattgactccagtgatattttagcatcctttatagattggccccctggactcgtaactgcccgtaatccaagtatgtatatgtgaaataacctcaggggtcggtgggagggggaaaggggttatttacacagtgtttgaagaagtgcaacacttgcagtttcaattccagaagtagtaggtaccgaggcatcctggatagactgtaaaagagtagtcaagaaatcctggcagttatcaatgactagaagccaagtaaaagctgcaagtcataattgctggaaatttgtttacatgcaacagtattttcaagggaaagtaagaagcagagggaaaagggcttgatatagagcagacatccgaacccaagtacttaatagtaggaggaaaaagaaggctgaaactagcttagaagccatctaaaaaagaaatatttagttggtctttatttacactaaattagaaaaaattttacttaaacctatgcctcagtctaaatttcccagtgaacatttgtggagatttggctatctagaatccatttcttccttctttgggcaacagcatccttatttcattttagagaattccctcctctctattgtatccagtcttggtggtgctacaagtcaacatgccctgtgctcctctaaccagtaatcatccaagctatgccagtaagactctccaaaatttaaatctaaagtggagtagcttaagaatggaaaaggataaagtcccagaaatagcgctccaacaaaactattgtgagtatcttgctgttcagaaaccgtaagcctggtcactagcttttaccttaattctgctgactacccaataatctttcaataaattcctttctgcttccttaactagacttggttcctattgttggcagcctaagaagccctgataaggaattaaagccattttgcctaactttgtccctggtctttccaaatgaaaactacaaatatttgaaaacaaaactaccctatagtttgttgaacggtgtttttatggctctattacagaagtatccagcatacttgcatttttcaagcacacaaaacttaaagggggcatttttgtttacttttcctacctcattttcagcagtattcactctattcccactgtttcctgccacgcttccccattacacgattttcttcataattgggccaaggtttactctagtaacattagctgtattgatttatttgtacatttgctgtctcgagaacttaagtaatttgagtagctcatattattgtttacatgttcaattatcttgtacttcttaacattttcaatgccattgcctttattctagtatcttttcacaaatatgcattactgtattaagtacaatgtgtccaaaattaattgttaaaggtatgataccagtatttgttcccccaggactcttcgatgaaataaatcagtaaaagaaaatctaaatgtataatttataaatttatagaaattgagaaatctgaaaaatgtagtgatcacctaatctaaggccataattttatagataagggaataggtctccctaggccattatccttgattccaacatctccattgatttattttgggttttatgtgttttctgtcattgcaaggggttcagggaaaaagatagcaactgtgtatgtccggtaatccctcttaaacaagaggaaaaagggaaataatctgacatcccaacttaaatcaggggcaccagtaatctcacagtaatttaaaggtcaaagtttacagttatcttaaatttttatttaaatctccttcctattcacctggccactgtaaagattaaatgaaagtaatttgtagactataaaatgttatatgagtcaagattttgttaatattgctattcttcatcctttcccttcccacggcacaaacatagagccattatggccttacatcaaaattataacacaaaccaataaagcccccatcccctccccattgcaacccatcctataagacaactttttgtactagactttcaattctttcaaacttttaagaaataaataacaccaattatatcagtctattttcacactgttgatgaagacatacccgagactgggaaatttataaagaaaaagaggtttaacggactcacagctccacgtggctaggaaggcctcacaatcatggtagagggcgaaaggcatgttgtcttacatggcagcaggcaagagagagaatgagagccaagcaaaaagagtttccccttataaaaccatcagatctcacaagacttactcactaccacgggaacagtatgtgggaaaccacccccatgattaaattctctcccaccgggtacctcacacaatacttgggaattatgggagctacaattcaagatgagacttgagtggggacacagccagatcataccaccaacattacacctactcttccagagaacaggaaaatataaaacacttccaaatgtgtgttgttgttgttgttgttgtttgaagccaggatagtattaatatcgcagcctcacaagaacattgcaaaaaagcaaagtcaaaagcaaatcctaatcgtgaacatgagtacaaaacacctgaacaaaatttcagcaaatcaaatcctgcgatatatagaaaggataataaaccatgatcaagctgggtctattctaataatgtaatatcatttactacagtaacaggatgagggagaaaaatcatatgattatctcaatagatgcagaaaaagcactctataaaattcaacaccaattaatgatttttaaaaaagaaactagcaaactggcaataaaatgaaactgccttggactgataaagcaaatccaaagaattcaaaagtcaggatagtggttgtcctttgggagtagtaaatggaatgagtaagaaaagagcttcagaagagctaatttctttatctgaatgcttaaaacccaaacgtggcaagttcatgagaatttactgagctgtacaaatacagtatgagcactttcttctatgtatattatacttcaacaataaaaaaacctatagcagtcatacttaattatgaaataataaaagttttcttcttgaaattggaaattacacaagcatgccactaacaccattgttcttcaacaatttattggagatcctaggcagtgcaataagaaaaagaaatagaagacatgaaggacgacaagaaagaaatttcatgcagaaaaccccaaaataatctatggataaagtattagaataaaaatacatagcaagattattggatttcaggtcaaaatagaaaatcaactgtttctatatatcagcagttaaaaaaaaagtttttaaatgacaccatttataacattaaaaatatccaacacttcggaaactaatggaagatatgcaaggtccttacagagaacactataaaacattattttaaaaatttaaggaagaggccgggtgtggtggctcaaacctgtaatcccagcattttgggaggccgaggcgggcagatcatttgagatcaggagttcgagaccagcctggccaacatggcgaaatcctgtctctactaacaatacaaaaatagccgggcatggtggcaggctcctgtaatcccagctacttgggaggctaaggcatgagaatagcttgaactcgggaggcagaggttgtagcgagtggagattgcgccactgcaatccagcctaggtaacaaaatgagagtctgtctcaaaaaataaataaataaattttaaggaagaaataaatggagagatatatcatgctgatgaaagagaaaatactgaaaatgtcaatttctccaaattgttctatagattcaatgtgattccaatcaaagtcccagcagaatttttgtggaaattgacaagatgattataaaaattaatataaaaaaatcaagagaattttgaagaagtgggaggaggtacaccatcagacaactagaataattaagacagtatggtattggcacaaagataaatgcatgaaccaatgaaacagaagagggtgcaaaatagactcatacatatattttaaaagattgggctgggcacggtggctcacgcctgtaatcccagcactttgggaggctgaggcaggaggatcacctgaggttgggagtttgagaccagcctgaccaacatggagaaacccatctctactaaaaataataataatacaaaattagccaggcgtgctggagcatgcctataatcccagctactcgggaggctgaggcaggagaatcacttgaacccgagaggcaaaggttgtggtgggccaagatcgcgccattgcactccagcctgggcaacaagagtgaaactttgtctcaaaaaaaaaaaaaaattgtactgcagagccacagagaaacaatgatcttttcaacaagtggtgctggttcaaataaatatcaatagcaaaaaatgaaaactgctatatgcctcacatcatataaaaaaagaactcctaatagatctatgaaaaaataataaaatatcttaaaagtttacataaatgaataactcatgacctttatataagcaaaattttctttttctgtcctttaatttcaacttttttttcttgctttttttataatttcaacttttattttagattcggggtagatgtacagatttattacacagatatattgtgtgatgttgagaattagggtacaactgatcctatcactcaggtagtgagcatagtattcgatagtttttcaactcttgctccgccgtcactcccctttctagtagtccccagtttctattgttgcaatctctacgtccatgagtacctaatgtttagctcccacctataagtgagaacctgtggtatttggttttctgctcctgcattaattcacttgggataatgtcctccagctacatccatgttgctgtaaaggacatgatttcaatcttttttatggctgtatagtattccactgtatatacgtatattttctttatccaatccaccattgacaggcacctcggttgattccatgtctttactattgtgaatactactgaaatgaacatatgattgcatgttctttttggtagaacaatttattttcttttggatatagacccagtaatgtgattgttgagtcaaatgatagttctaagatatttgagaaatatcccacctccacaatggttgaactaatttacattcctaccaacagtatgtaagtgttcccttttctccacagccttgccagcatctgttgttttttgacttcttaataacagccattctgagagatggtactcattgtggttttgatttgaatttctctgatgattagttatttgagcattttttcatatacttgttggtcacttgaatgtcttcttttgagaattgtctgttcttgtattttgctcactttttagaagggatatttggtttttgctttttgaaatgtttaagttccttatagattttggatattaaacatttgtcagatgtatagcttgtgaatattttctcccattccataggttgtctgtttactctgttgatagtttctcttgctgtgtagaagctctttagtttttaaattaggtcctactcgtcaatttttatttttgttgcaattgcttttgagacttagtcataaattctttcccaaggccaatgtccaagatactgtttccaatgttttcttctaatatttttatagtttgaggtcttacatttaaatctttaatctgtcttaatttttgtatatggtgaaaggtaggggtccagtttcattcttctgcatatagctagctggctatcccagcactatttgttgaatagggagtcctttccccattgcttatttttgttgaagatcagatggttgtaggtgtgtggcttcatttctgggttctctattctgtcccattggtctatgtgtctgtttttgttctagtaccatgctgtcttggttaccgtagacttatggtatagtgtgaactccaataatgtgatgactctggctttgttctttttgcttacgattgctttggctatttgggctctttttttagttccacatgaattttagaatagtcttttctaattctgtgaaaaatgacgttggtagtttgataggaatagtattgaatctgtagactgctttgggaagtatggccattttaataatattgattcttccaatccatgagcatggaatttttttccaatgtttgtgtcatctataatttctttcagcagtgtttagtagttctccttgtagaaatatttcacctccttgattagcagtattcctaggtattttgtttttgtgtgtgtagctattgtaagtgaaattgtgttcttgatttggccttcagcttgtacattattggtgtatagaaatgttactgatctttccacattgatttcatatcctgaaactataatgaagtcatttattaattccaggagccttggtgcagtcttacaatgttctaggtatagaatcatatcaccagcaaggagagacagtttgacttctttttttcctatttggataccttgtatttctttctcttgtctgactgttctaactaggacttcaaaattttcttaaattgaatacaaaaaacactaactacaaatgaaaagattgataacttgcattagctaaaattaacaactattattcgtcaaagacaacattagaaagtaataaggcaaaccacagatgggaaaaaacatatgtactaggatggctaaaattaaaaagattatcaataccaaatgttttggataagaactactcatgtatttccaggcggagtataaattttttacagccactctggaaaaatatgcatacactataacctagcaataccatttttagatataacagaaatgtgtatgtatgtgcatgtgtgtgtataccagttagaaagaagcatgagggtgtttcttagtactggtaatgttctgtttcttattctagatggtacttgcataggtcttttgcttcataataattcataaagctgtatacttacagtcagtgcccttttctgtatgtatgatatacttcaatttttttaatcaggggaaaaataaggagagaaaatcaccaatgtgaaacaaatatcagaaatgcccatccaggaacctgaaatcatttctcactggcacaaacactacccagtgataaaataaggacttgatatttagacaacaacaaaaacctgatgtttcagtttatctatacagccttagtaaatgtaagtatgtaatttcattaagctttctgaaatgctaaaaacaattttaaagattcttattgtttttgtgtacccttttgtattcacagatcccagattagaaattagtgccctagtctgaaaagaaggatcaccagacaaaaatattcagtaaatgttgcctcttctctttataatctatatgttaggtttacactgaaaactatctctttagggaaattatatagatacaccaatcctaagtaaacatttttaaataaaatgatgagggtcttattctcaattgtttccaacactagatacattataaaaagaagttttgtccctataacccccaaatctatgttctttgttaatcagtgtgtcacagttcaaatcttaatcacatccaaaattttgtgaccttgggcaaatttcttaatctgtgtttcaatttccatatctggagaatggggatgatgtgactaatacctacctcatagggctattgtgaagattaaatgcaataatgcatgtcaatcacttagcactgtgtctaaatgttaggctattattattatcaccatcatttttgcctatttatttattttttaaagtaaaacactaaattgctgattacaaatttgtgagcatgaggaagactgttgacataagggcttcattctcagtgatcatgttaggaagtaaccttgtactgggggatttctagatatcagtatatgaagtcttctttggagccactcgattctttcaaagaagaatacatttttctcctaacctggaaagtgctgtctagttgatgatgctgtgcaaaggaacaggaagaggagtttaactgctccatagatcaactttctacctatccctttgtttactgcttaaagactcattccctaccctcagctctacctcgtagttccaagcccttcaaatatttaaagatagccgttattttattctgagtcttctcttctccagttagacatacccatctcctttaactatttacagaccattctctttcatcatcagtatattcattcaaatctctgttattgtgatggttaattttatgtgtcaactgggctaggccacagtacccagatatttgatcaaagattccatgatggcaatttttaaatgagaataacactaaatcagtagactttaagtaaagcagattgccctctgcaatctaggtaggcctcgttcaatcagttgaaggccttaacagtctgacctccctaaaggaaaaggggattccaccagcagaccacctttggactggaactgcaagtcttccctgagtctcctgcatgctggtatgctctgcagattttggacttgccaaatctccataatcttgtgtgccaattccttaaaataaataaatctctctctctctctctctcacatatatatatatatatatcctgttggttctgtttctctggagaaccttgactaaaacagctatgcttcaggaatacaagtagaaaacactacctacctttgtggatatgccagtctaacctcactttattatatccaaataactcttaaaactgtttctaggtcacatggacctatgcaatcagaccaatgcaatttgaccataatatagaataaataaactgcaatttcacctccctaatataattattttaccgcaaccaaagagcaacctaatccacatcactgcttatattgagtttaccataataaaatccccaaaaacttcccacaagaactgttacagctcaccaattctgtatttgtgaattgttttggggggcctgcacataatacctaacattttttcctactaaattttatcctctgaaatttagtttttcattgactgctgtcaagatattttggattccagattctgtcatttcaatacatttacaaatactctcagctccatactaatgaaatattagtctttatcaaactaaaagaggcatagctaagatcaagagaagtctctgacatcatcaactataaacaaagcctgaattcaaataatactgacatacatatgctgctattaaaattctcagggagtattagatatgcaaggaaggtgggacatatgctgctccagacaggcctggtgtcaactgctgtctctaaacttacaagttttataactggacaatttgcttattcctcaaagagtttcaatttccttttcaataaaatggtaaagataaaacttacatcacaagactggtgtgatgttcaaaatacacataaagcacttgacagaatgcctaatacattgcaaatacttgacatgtgtctactttgaagcacgtattatagtaagaactcagcaaaggtgagatacattcctgcttcatcactttcccttggatcaactataacctaaataacttaacctctcctggccttggggtaaagaggtagacagagggggagagaggcagatggaagaataaagttgctgcatgaagttgctacctaaagagactattttaaaggctgagaatcctttaaaagatatcaaatagtttagaaagatgctttgacttgggctgttagaaaactgcagcttctagtcagaaaagaataaatgcagtgatgtttgggatttggttaaacatttaaattgcatttcaaaatgttggatttggcaaaatttaaaataaattttgccaagtccttaagttttttacttgcatgtattcaagggaaagccagcttgtagatttgaatcatttagatttaactcattaaaatgtatagagtgctttatcaagccacaaaaattgtgccccaaatcatttacagtttaacttagaaaaaaaaaagtcttatataaaccacagctcttgtacactaagttgctgagacttagaagaaaagattaactcagaaagacctcaagaaagaaagaaattttgaagaagtaatgaaaggagtggaatagcactgaatgcacaggaaatggaaaaccattccaaggatgcagacagaagtgatattacataatagctgacacagactatatgcaaatttcagtgattggattttgacttaaagatattttcctgaaatgtctggaagaacaatgggactttgggggcatccataaaattataatcaagatctattcagcagatgtttactgtgtgtctccacgtgcaaagctctctaacaagcactgagaaacaatgctgaatgggacagacatgtccttgccttttggaagcttacagtctattgacaaaatagacttttttatgtgaaaacagaaaataataagggctaggaagtatcaagatgtaggaagcagtcgcattatacacggattttaaggtgtaacataaaagaatcatacattttcaatttcttagggactttgaagttcatcagtccagtttttccaagaggaatccaagacagcaatatgtaaactgcttcgattgaggtagggggcaaaaggaaaagcaaagccagacctggacacaggtgtcctaactctatatcaaacatccattccttcattcaacttttacgtgatatttactatgattaggcactgtgctaagtgctgcagaaaaggtaaaaattaaaaacacctctccctaacatggtcctggaagagagataagtatgaaaataaacaatccccaaaagataaatgatgtaacagaaaaattgcacaaagttgtgcagcacccaaaagcaagaccctctctgcttaggaagacaatggtggctttacatcagccaaatcatataaaatgagtaggattttcccaggaacataaaaagaagagaattcaagaaagaagaaagaggccaggcgcagtggctcacgcctgtaatcctagcactttgggaggccgaggcaggcgtatcatttgaggtcaggagttcaaaaccagcctggccaatatggtgaaatctcgtctctactaaaaaatatatatacaaaaaaattagccgggagtggtggcgtgcctgtagtcccagctactcgggaggctgaggcaggagaattgcttgaacccgggaggcagaggttgcagtaagccaagatcatgccactacattccagactgggcgacagagtgacactgcttctcacaaaaaaaaaaaaagagagagagaggaaagaaactgtgcaaagaacactgtatgtttggaaaagtataagtataaaaagtatgagttcttttacttctgagctttttttcttaattagttttatcaaagtaatacatgcacatagtcagatggtgcaaaaagactcgaaacacagcagtcctgtggccacccttctgctggttacactaccatcaaggttctctcagtcccagatgcaaccatgttaaattggtttagctgctgcttctggcatttagcgccatgcttctaaatcacgtgtgtctatactgatatactggtatcctacacagtataagaactttcacctcatacccacttcacccccccaccccagtccccaatatggttgaaacataatgtggggtgatatccataattgtagttataatgactaagtaaatattgcttgctgattaaggtattatactctgactatatttcctctctgtgataccttttcctttttctaatgttgatttgcatgtacttgattgttctcttctactctctggtttaatcttcccccacattccaatggctctaaagccatttctaaataccatttttcttatagtcaaacctatcagataatctatttttccccatgattatgccccctagaaatctgcccctgtactcaccccttggcctgtcctaggaattccttctgtctatggtgtaaaccaagaaataggaagcctccaaatctaggaaacataggctctaacaatctcactttgatagaacccacattctactagcttcctgagaaagaatgcatgagaggtaaatttattttcatacatttgtcagtcatccttgactgatattttaacaatgtaaacaattcaaggttgaaaattgctttccttcataattattatcttctagtttctagcgttgatttgtggggcttttcggcttctcaaagtatgagttaggattgtgtttagttgtaggtaaaataaaatccaacaagttataacttagccaaatagggaacctgaccaggtgctgaccacacctgtaatcccaactctttgggaggccaaggtgagtggatctgctttgagcacaggagtttgagaccagcctgggcaacatggcgaaaccccatctctaccaaaaatacaaaaattagccagacattggtggcttgctcctgtagtcccagctacatggaaggctgaggctggacagtcatttgagcccaggaagtggagggtgcaatcagatcactccactgcactccagcctgggtgacagagtgagaccctgtctcaaaacaaacaaacaacaacaaacaaatagacaacctcccacccccaatgtaacaagaaatccagagacaggtagttgctgaaattgattcagcagttcaggtatatcagagctgagaactctgtgattctcatggtcgcaaaatactgtagctccagacatcttgttcaggtttcaaatgagaaaaagtagaagagaaaggagaagattcaacagatttccacttacattttatgggccagcactttaccacacttggtcatatctaactacaaaggaattgaaaaaagtaagcttttagctttccggcctctacaatgaagaaaagcaagggttgaaagagacaaactggaatatgagataacattacaatgtgctttggtgtgcgtcttttcaaaaatcttttgtgctgggcactctttgagtccttctaagtttgaaacacatattttcagtcctagcaattttccttttaaaatttagttgatagttttatcctttttgttttttcattctctctggagagctcctaaaagtcaaaggttgaacttctgatactgatcatctatcttttttctcctatttcccatctcattatctttcacttcttttttattttaagttccgggatacatgtgctgaatgtgcaggtttgttacattggtattattttttacttcttttttaggagacttcctcatctgcatttaacccttttattgaatattttatttcttaagtgctttcttactctcttattcttccttttctatagtattatgtttttattttatggttgcaaaatcttctcatctttctgagggtactgattataattccttgaagttttcttctttttcctgacagtctttcttctgagctttattttgttattgttattgtttatttctttgttagttttgatctcttttcctgttggagtttctccttaattgactggtgataattgattctgtgtcatatctaagaatgaggtactagaagggtgactagaagctgcgtgcatgtggccaaagcttaatgagtagtaagctttactaaaggacaatcaggaagcccgttagtttcctcatcagggaagcccacatgtcagtatctacagagtttttctctgaagcatgttatcccttcagagaaggatcacctatctgaagaggtgttaagagagaaaggcagttataagccttgctgctactgttgtagaactcagcacaggaaggcagctagaagtctcaccattatgcagatcacttaattcccctcactcctatcctccctactttgcagtctctcaggttcagttcttcacagattatacgtttcatatgcagcagagacagggaagtggcagttgttagtgcctagtagggatgactgaaaaatataattaattttaaacaattcttttgtttgtatgccacccacatcatctctccctcacaatcacactccaacttccataatacctaatttctgattcctaagcctatctcagattctgcaggatgaatcagtttgtttatcattggtatatccctctgcagataattagattttacattcttgctgctaagttatctacaattcttccatatgctttcaattttcctatactacagatgaaggttagagaaatctagttttcctaaagatggaaagtacctgttgcttttgtttgtttgtttgttttaagtgatttctagtaaagaagtactttttctgccattttgaaacaggtaagtctctaattatgaatttaaaacttgaagacattgatagatatgaacaaaatatgctccagagcaaaactctacccattaacaaccagatcatgcacgaccagattagaatggccattatattgttggttatccccattctggtaatatgacgtagcagctaagagcatgagctctgaggtcagattgcctagccttaaatcctgtctctaccactttacaagatgcataatcttgcacacattctgtttatattatcctcttgacctgaaaaaatgtagagtgatgatgaggattaagtgaacaaaatgcctggcacacaagtattcaatatatacaaactactattattaactccaacagatcaaattttccaaagtagtgagagtaatatgcactaagcgccttacagatattaacttactgaatcctgaaaacaatactatgaggtagggatatcaccgtgccaattttataaaagataaaactgatagatgaacaggttaaataacttgcccaaggtcacacggccaaaagtagataacagggattcaatctgaagaaatctggttccatcgtctttgatcttaaccacttacaatacacagcccaaggatagcatcattcaaatttgagtccccaggttctctctagctctcttatggaatgccaagtaagttatattcggtaccacagactaacttaaaggaagatttcaaaacgacactgcaaaatttggaccaaattatttctccatttaactgccttctatgtacaggtagtagtatagaatagttgtgtacatgtgatgctcatttccataatgagtaaaggacataaaacataaaaatatcatgcagtttttaggcctattgctcccaaatcattcactctgattatatcctttattacagggaaatgtgttttctaagtctatcttctttgcatggattgaaagatttgtgaaactgaaaactaaccttcctctgccaagagccccatcaagacagaagttcttaattaactaagcaattagtcataacaagtgaaagctaaaatggagcatgaatacataatttgctgattatttttctccactagaacccttagccagaatttaacaaaaagtgttctgtgggtgctagttttgggaaggatggtaaaacctggacagaatgcactgaacagctatttgagggctccaaagagtaaagaattgcagatggattggagaagaccagaattcaaagtatcagcagtgcgtttcttgtttttccttagtatcccccagtctggtgtctacacctggtacaccaaaaccaggagtagacaccagcatacaaacagagagatttccagagaagtcctctagctctggctcaacaggtaggaaaacaaagagatttctaacactcagagagagtgggggaaattccaggtttttctcttatatcatcattattacttatgttttctctctttcatgcctcagtctccaggccatcctgtggcagtggcagcagcaacaatggcaagcaatggagtgattcacaggtgcctgaaacttggatagaagtgtagtccacaagagagaggcaaactcctactgctttttctctctatctctgtttacctacctcttgaacctaaacatgggtacaactacaggatgtgtgtggcagagcaggataactaaaactccagtttgtggccaaggaaccaaaaaatactggggatattgcggagaaagggttgggatatgagcccgtcctgagctgcacatacagagatatgatcttgaacacctaacaaagacttgagaaatgaattaaactactgaccactacccagatctcagactggctgcttggttgcaaatatgtgggacagagcaaaagagcatcacagagcgtttgaaaacgaattgacactgaaaccacaagccactgaaggctgatcagaccttacaacctgaattctctgggttgattgcatgctaaaataaaaatatcaacattcaccataggatgtaaataagacccagagtctcataacatgatattcaaaatgttcagaatataatacaaaattactcagcattacaaagagccagaaaaatttcaaattacatagaggaagaaatttcacagacatcaatgccaagatgatacatatgttagaattacctgacaaagatgtcaaagcagctattaaaaacactcttgaaataaatagaaagtttcagcaaggaaatagaagacgtgaagaagaaccaaatggaaaatttagaactgaaaaatgcaatagcaaaactttgaaaactcactgaatgagttctgtaacagaataaaaatgacaaagtatcaataaacttgaaagcagatcagtataaattatccaatctaaacaacatagagaaaaatactttaaaaaataaataagagcctcaggacctgtaggacaatatcacaatgcctaatatgtatatcatcccagtcccagaaggagagaagagagagtatagtacaaagaaaaacaatgtaattgctaaaaactgaccaaatttgccaaatgacataaacccagaaattcaaaaagttcagtgaactccaaaaagaataaaccccaaaatacccatacctagacatatgataatcaaacttctaaaaattacagaaaataatgttggaaagtaaccaaagaaaaatgatgcattacttacagggaagcaatgatttcaaagtctgaggatccctcatcagaagtgggagctaagctatgaggaaacaaaggcataagagtgatataatggactatagagacttgcgggaaagggtggggaagggggtgaaggataaaagacaacacaatgggtgcagtgtacactgcttgggtgatgggtgcactaaaatctcagaaatcaccacctaaagaacttatccatgtaatcaaacaccacctgttcccccaaaactactgaaatcataagaagaaaaataattttttttaaaaaagaagtcatggaggccagaagaaagtgcactcatttttaaagcactgagaaaaaggaaccatgaaaccagaattctgtatctagcaaaaatactcttcaggactaacaatgagataaagacattcttacatgaagaaacactaagagaattttcattagcaacagacttctctacaagaatgactaaaagaaagttcttcagccagaagataatgatgccatatgcaaatgtggaacatcagaaaggaagagagaacaacaggaatggtaaatttctgggtaaatataatagactattctttcaccctgagtcatttagagtatgtttaacagttaagagcaaaaaacagagcattgtctgatgagattttcaatgtgcaaacagagtccaaaactaggcctacaaaagtatgatcaatgggtttttgacgaaggtacaaaggcaattcaatggagatatgatagttttttccataagaggtgttggaacaaatggacgtttcgaagcaaaaaaacaaacaaacaaaaaaagaacctcacgcattatacagaacttatcttaaaagagaacatagacataaacataaaacataaaactaatttaaaacatcaaatatagttttttgagtaataattggaaaaaatcttagtaacattagtttaggaaatgatacaccaaaagcatgattcataaaaaaaattttgataaattggacatcatcaaaataaaactcttgctctgccaaagaccctgtaaagaccatgaaaagacaaggcatagacttggggcaggggggaatctgcaaatcggccgggcacagtggctcacgcctgtaatcccagcactttgggaggccaaggcgggtggatcacgaggtcaggagttcaagaccagcctggccaacatggtgaaacctcgtctctattaaaactacaaaaattagccaggcgcattggcaggcacctgtaatcccagctacttgggaggctgaggcagaagaatcacttgaacctgggtggcagaggttgtagtgagctgacatcgtgccactgcactccagcctgggtgacagagtgagactctgtctcaaaaaatctgcaaatcatatatcaaacaaaagatttgtatctgactatatgaaaactccccaaacttaagaaaacaaacaactcattaaaaaaaataaatacatgatttgaaagaaaacttcaccaaagaagatacatagatactaggttggtgcaaaagtaattgcggtttttgtgattactcttaatgctgaaaaccacaattacttttgcaacaacttaatagtaaataagtacatgaaaagatgctcactgtcattagtcattagaaaatgtaaataaaaatccacaagaacatgctactacacacctattagaatgggggaaaaacagacaactgcaggtattagcaagtatgcagagccattggaactctgaaacattgctgatgggaatgtaatattacagccactttggaaaagtttggcagtttctgacaaaggtaaacattcatttaacttatgacccagtaattccactcttagttatttgcctaaaaggaatgagtatttgtttcacaaaagcacctgtacatgaatatttacagtagctttattcataaataaaaaatgcatatgtccttaaactggtgaatggatggaacaaaactaattgtggcacattcatacaacagaataccactctccagtaaaaatgaactattgatacacacaacaacatgggtgaatcacaaatgcactatgtaaagtcaaagatgacagatgtaaaacactatataccatataattccatttatatgacattctggaaaaagcaaaaaaacagggacagagaaaagatcagaggttgccaaggattagagctagggaaaaggctgactacaaaagagcagactgaaggcattttcagagacaatggaaccctttagtatgttcattgtgatggtggttacacgattacatatttgtccaaactcatagacctgtacaccaaaaacagtaaattttattgcattttaacgtttttaaattttaaaacaaatttacctatttaaaaaaaaaaacaaagacagcaacaacttaggatcccatattaccatcactatttaatgtgatcttagacaaatcacttaatatagagctttggttcccccaatttttaaaatgaaaaatatagtatttatatctcataggtctttataaaaaagttttttaaaggtttcaagatcctgccttttcacattctatttcttctgaaatgtttcttcccatcctctcttccctactttgcttggctaaatgctatttgattttcaggtctcagcttaaacgttattttttcataaaagcttctcctaactcacattttaaatcagggcctcagctatgcctttactgcccagtgtactcttatttcataacacttctcatgtccttttttttttttttttttgagacagagtcacccaggctggagtgcagtggcccgatcttggctcactgcaagctctgcctcccgggttcctgccattctcctgcttcagcctcccgagtagctgggactataggcacctgctaccatgcccagctaatttttttgtgtatttttggtagagacggggtttcaccatgttagccaggatggtctcaatctcctgacctcgtgatccgcccgcctgggcctcccaaagtgctgggattacaggcttgagccaccgcgcccggtctttttttttatttcaagagcttaggcgtacaagtagtttttggttacctggctgaattttgtagtggtgaagtctgaagttttagtgtacctgccacccgagcagtgtccattgtatccagtatgtagtttttttatcccttacccctcttctactctccttatttctgagtcttcaatgttcattatatcactctgtatgcctttgcacgcccatagcttagctcccacttataagtgagaacatatggtatttggttttccattcctgtgttacttcacttagaataatggcccccagttccatccaagttgctacaatggacattatttcattctttattttatggctgagtagtattccatggtgtatatataccacattttctgtatccattcatcagctgatggacatttaggttggttccttatcttttcaattatgaattgttctgtgataaacatatgcaagcacatgtattttttttatagagaggttgtactaacttacattcccaccagcagtgcacaagcattcccttttcaccacattcacgccaacatctttgttttttgattcttaaataatggccattctggcttgggtaagttggtatctcactgcagttttaatttgcatttccctgatgattagtgagtacatctataggtaaataattttatttaatgtctgtctctttcatgaaatggtaagctctgtgagggaagaaattgttatcagaatacaagcagtacaaagtgtctgaaacactggtgaatattctgtacatatttttaaacaaatgtgcaaaaacacaatggcatttcctattgtgtaattaattctttcttaatatctttacctttctcactatttatatgtatagacacatgtatcttaatgtttttatcttcctcaccctgtatatatacacatacatatatatgtatgtatgtgtatatactatgcataccatcaacaaagtttcttagcaaatgtccatcaaaagataacaaataatagattatgccttggttgacatacctgtttactaacttttcctcatttgtagtcattaacactaattgaacctgacaaaaataagatgtgacagacctactgtatatccacaagtcaaattaacaaattagttgaagaatcaatacatctacatatgagtctactaactgttgggcatacatccagacttacatgcagaaaagcacttaagaaccaaacctttttccctcttatataagctgtcaaaaatgttacagatgtgacatttaagaaactcagagcatgacttatagattaccttatgcataatggtaaaaattcctctagaacaaccagcaacattaataattagttggaactcaattacggatacttgccaaagcaaatccccagaaagctatcttgtatctttcaacctggccttgtagaaatgatctaatgtagcatcctacagtgtaggtacgtggggtattaatatcccaccctccttgatgggtcagtaactgaaacagtgaaaggctcaatgaagatcgcagcactaataaacgatgggacaggtattaatactgcaatgccgcactgtccaatatggtaaccactgagccacatgtagctacagagcacttcaaacgtggctaatccaaatcaagaagtgctgtaagtgtaaaatacacaccagatttcaatacttggtacaagataaagaatgtaaaattctcattatttgtttatactgaatacatgttgaaatgactatgggttggattaaataaaatcattattaaaattaatatcatctgtttcttttcacgtttcaaagtgtagttactacagatttttaaattatatatgtagcttgtattatatttccagcggcatcatgatagagcactcctggatcagtatggttgaataatagaagacatgtggaggcaaacatttaggtttacttcccagactctaccatatacacacagagtgactttgcagaagattattgtatatcactaagatgacttttcccacatttaaaatcagaacattaaatctatgatacagtactagtacgaggttaaataatacattaaaggtctaataatgtattctacaatgaatagccacttgatgttaatttctcttttcctcctttttcctaatccacttccctgttaatttaagctgcagttaaacttccatagtggacagattagtccccatgcctactattcccagtacctcggtctaggttaacacaacctccatgaccagaaaaccaggtacagaatggtggtcactgagtagcccaaagtaggtatgacacaagtatgacctgtctgtagtttggcatagtctaatacaatgggctcaaatagtgaaaaacagcatatctgctcccttcagaattcatccaagaaacagagacagactggttaataacaaaagggtaatggaagcagacgtagaaagagacatagaagtaacaagatggaaaagccattcatttgttcactccacaaatattaatgactgtctatttattacatgctatatgacctgagagaggaagtaacaggggaataattcccagagctttataagacccagacaacttccagttccagtccaaatgtctctttacaataaatattttttctttagatgaatagatgaaggctctgctccttgaaactaaaatgacctaactaacgtagcttcacaaaggaaggcacagaaaagtgcctttttgttagacactcacacacacaaagacaaaatatgtattgccctaggtaataaatcaaacaaaaagggttcttcctcaaagtgggccattcctttcctaaaaccagtaacagacagaacagaaaacaagtggagatagcaagggctactgacccttaatattcctttagaaagccactaccagaaatacacttttaagtgccttacctgcactgcatagaaatatgtaggcaaagagaaaaaagatcggccaactaaaactacagactataagtacttattaaagactactttcactaacataaatgggattcactacatcagagtcccctgatcactttttgcagggcagtctgtgggcctcactaaactaatttgcgatattaaggtaaggaaagaagaatttcctcattctaaatgtattattggacaggcttgaagtccaggtcttaagtatggttacataagggacaacaataactatttgtttcaaattgtatctctttcaataaaacaatatctcagtggtttcagcagggagtacaaaatctgatctcttaaccctaaaattccaaccctggaaaaatggctcaccttcgccaaaacacacacacacacacacacacacacacacaactagagactgattttccacacaaaatttatgtacttattaaaaaggaatttactttataattatgtgcaagaattatcatggtgagaagtgaatgttggttttaatcattgccagtagatcctcccatcagccacataatcatattcactttatggaggaagcactattactccgtaccaagcatcttatataatatagctctttgttttcatccctgtgacaaaccatgtgagatggctgtgtgacccttgttttaaaaacaaggaaactgactgctggaaaggtaagtaacataattatccaagatctccaacctaacaaatgtcaaagtatgggagctgaccttgggcttttatgctcttgtccacaataatccagagcacccagaacatttatatctctaagaagttaagtttagaaaaatgcatctttttttgcatatatgtcaccaacttcgggtatttcttattacaagagacctttttgcttaaagattccaaatcaatcacccatcatttttctaacactataaattctaaatgcaaatgtcaactaagaaaggtctatgaacattttaaaaactcattttccccaaatccatatgagtctgaatgctgagaaattccacactaaaggtagaatacttaacaaaacaccaacatttcccttcagaaataacaaagggaaatataagtttgtgctcactttttcataatgtcatggcatgttaaaagatgaaaacctagtaacaaagtcaattaatagaatctacaatctttttaaaatattttagtagcttaagaagcatattaaaactagaacctaaatattaggctggaatcgtggtacatctttagctcttccagaatcatactcacagtggggctcacactgtattttaataagcttctaggtgggcccattcatctagcagcttaaaacctccccaggtgattccaatgtgaactccaggctgagaactgtcatagttgaaaaccactggactggcacatgagagcctgatttctgctgaatgtcctttctttgagctcttctcccccagtcctatgaaaagcatggtcgctgattaactcagagttaggtgaagaaaatcaaacttggagagataattataatagataccgtgatggttaattttgtgtgtcaacttgactaggctatggtgcccagttgtttggtcaaacatagcctccatgttgctgtgagggtatttttaaatgtaattaacatttaaatcagtagacttttagtaaattagattaccctccctaatgtagatgaggctcatacaatcagtcaaaatcttaagagcaaaggctaaggtttccagaagaggaaggaattctgcttcccaaatgcaacactgaaactctacctggctttccagcctgcctggcatgtgctgtagatttcagacaggactgcaacatcaactctttcctgaatttccaggctcccagcttgccttacagattgtgaacttgccagctcccataatcacatgagcgtattccttaaaataagtctctttctcactcgcattcatggtgtgtgtgtgtgtgtgtgtgtgtgtgtgtgtgtgtgtgtgtgtgtgtgtgtgtattctcttgtttcaatttctccaggggaccctaatgctagataccattatttaaacacagactatgtactagaaaccatgctaaattattcacatacattttctgagttagcctttacacaacccaattaaacagttgaataagcaagctataaagagaagatgtgaccagagatagggaagcttcctttagtggctgtggagagcaagcagtacagaagttagcactaggtgagccaagaaaaagccaaggacaaaagaagataaggtgttcattgaaaaaaacaaaagacaaaagggaaaggggaaacctatagatttaaaaatacagtgcccaccataggaaaccattcttctactttctgcttttattgctttgacttttatggacattacacttaagtggaatcacacaacacgtagtcttgcatctgactcctttaaagaagcataatgtttttgaagtttattcattttgtagcgtgcatcaatagatcactcctaaaacttcttgaatatagaagtggaatcatgtagtagtaggtctatgtttaaacttcaggaaactgtgaaagcagttttccaaagtggttgcaccattttatattcttaccagcaatgaaggttccacgttctccatatcaatgccaaaatttattattgctaactttttaaattataaacaattgagagtgtgtgtgtatgtgtgtgtgtgtttgtgtgtgtgcagtgtgtactatatagaggttgtttatatctcattgtgatttttttaaaatagagacagagtcttgctatgttgcccaggctggtcttgaactcctgggctcaagcaatccatctgattctgactcccaaaatgccaggataacaggtgtgagccaccatgcccggccctcgttgtgattttaatttgcatttgtctaatgactatttatgttgagcatattttcatgtgtttattagccatttgtagatcttcttcagtgaaatgtctattagaatctttgactattttaataaactttggatattggtacttattttaataaaccaactgtaaaatatgtttatgataaaattgtggaaatttaaacattcaaaggatacttgatattaaggatttattagggttgttttgggtttgataatgctattgcagttatgcttttagaaaaaaatctttaccttttaatgtgacacactgaataatttatagatgaaataatgtgaggtctgtgatttgctataaaataatccagaggaggtaggggaatttatataaaagattggccatatgttgacaactgatagttcttggagctgagaaaaggattcatggggactcataatactatgtttgaaatttccataataggtttttttgtttgtttgtttgagatgcagtctcgctctgtcacccaggctggagtgcagtggcatgatctcggctcactgcaacctccgcctcccaggttcaagcaattctcctgcctcagcctcccaagtaactgggactacaggtgtgtaccaccatgcccggctaattttttgtatttttagtagagacggggtttcaccgtgttagccaggatggtcttgatctcctgacctcgtgatctgcccacctctgcctcccaaagcgctaggattacaggcatgagccaccatgcccagcccacaataggttttaagaaataaaagctgacacaccgaatgcatgcattaacctacatatacactctctcaaaatctactaaatacaccgtaaagggattttttaaggcataagcaacaagaagaaaaggaatgggaatgaagacaacagcaacaaaactttggaagctagaaagtatatggatgaacatgaaccaacttgagaaacctgaatccccaaccagaagtggaaaaagccaagaaaacaacctgatttacacaacaaaaatcttcaaagggtttaggaataggtggcatcaggtacatctctggagataagtttgaaggtggaactgaacaccaaggaataactgaaagtagatttaagaaaatgaacctccagatattttactacactctacacagccaaccaaccacccctctcctactccagcaaatgactttggcttattttctgcagagtcaaagagaggttctctgcgatgaagaatccaagctacggttgagggtggggacaaaatactaaaatgaagaaaataagtaaaagtctacagattgaatatagagacttcttcctcagttcagctcccagaatgcttatagagaggctaaaagattagaagaatctggatgtccaacaagaaagactaaaagatgctgacattagaggaccccccaccatgtctgctcactccacagtaataagcttcacccacgcacacagagttcgcactagctttacagagcccaaccttttcttctgagtcattaattggtagagataacttattggggttcagggggttgatttaaaaattgagaactataggccgggtgcagtggctcacaactgtaatcctagcactttgggaggccgaggcgggcagatcacaaggtcaggagatcgagaccatcctggataacacagtgaaaccccgtctctactaaaaatacaaaaaaattagccgggtgtggtggcgggagcctgtagtcccagccactcaggaggctgaggcaggagaatggcatgaacccaggaggcagagcttgcagtgagccgagatcgcgccactgcactccagcctgggagacagagcgagactccatctcaaaaaaaaaaaaaaaaaaattgagaactacagaaaaagttacagatttatgactatatgaggaagtaatgaaaagccatttcatgaagcagtggtgaatcaagtttttactatatgttacctcttgggagaatagtttatactaaattacttgttttattaaaaaaagaaactatgccaaaaaagaaaaacaatataaatggtcaaatctaatatatttttggctttctttttgacaaactgtctgtaaaaatggtgtctattgttcccatatttatgaccatgtgtatccaatgtttagcacctatttataagcgagaacatgtgttatttggttttctgtttctgcgttaattcacttagaataatcgtttccagctgcaaccatgttgcctcaaaggatattattttgtccttttttatggctgtgtagtattccatggtgaatatataccacattttccttatccaatccaccactgacgggcacctgggttgatctcatgtcttcgctcctgtgaatagcactatgatggacatacggagcccaacttttaaatacaaatggacaaccaaggatcacaggacattttagaaaagccccaaacatgaaaaatgaaggctgaaaagtgaaaacctgaagagatttgtaaaataaacctaagtgttagataaactgacaaaatttcccagaaagtaaagtaaaaagatttttaaaggtacaaatggacgagcgcagtgactcacacctataatctcaccaatttgggaggtcaaggtgggaggattacttgagccctggagtttgagaccagcttgggcaacatagggagacccccatctcgaaagaaagaaaggaaagaaaggaaggaaggaaggaagggagggagggagggagggagggagggagggagggagggaaagaaaagaaaagaaaagaaaaaagaaaattagccaggtgtggtagtgcacgcctgtagtcccagctactcaggaggctgagacaggaggactgattgagtctgggaggtcaaggctgcagtgagccatggccatgccaccgcactccagcctgagcaacagagcgggaccctgtctcaaaaaaaaaaaaaaaaaaaaaacaaggtacaaatcgtgcttgatttaccatggttcaacttacaatttttcaactttaacttggtgcaaaagtgagaggccttcaacagaaactatacctatacaaccattttgtttcagtacactattcaataaattacataagatattccatactttattataaaatagtctttgtgttagattatttcaccccactctgtgatccaacaattcattatatccaacaatttattataaatatataataataataatatatccaacaatatattgttggatataataaatatccaacaatttattataaaataggctttgtgttagatgattttggctaatgtaagagttctgaacatgtttaaggtaggctagactgagctacaatagtcagtaggttaggtgtactgaatgcatttttgaattatgatgttttcagtttacaatgggtttatcaggacataatcccatcacaaatcaaggaccatttgtataatagttaattttatatgtcaatttggctgatccacagtgcccagatatttggtcaaacatgattctgcatgtttcttggcaaacatgtttttcgatgagattaacatttaaatctgtggattttgagtaaagctgattattctccataatgtgggcaggtctcatccaatcagtcaaagaccttagtagaacaaaaaatgaccacccagaagcaagaaggaattttgtcatcagactgaaatatgtattagtcagggttctccagagaaacagaaccaacgggatagagaaatctagaaaaataattactataagttacctagaggctgagaagtcccatgtggcgaaatctccacaaacacatgaaccaattccttaaaatcaatccatcaacccccaacccgtgtgtgtgtgtgtgtcctttcgattctatttctctggagaaccttagtaatataggatagtaagaaataaagcatttaaaaaaggaaagtcaaagccaggaggtcaacatcttaacaggatatccagaaagacagaacagaaaaaacaaacttgactaaatcaaataaataattcaaaaaactaccccagaactgaagaacatgactttctggattgaaagggcccacagagtaccaaccacaaaaaaaacagaaatagatccacatgaactacctgcttaacacaccagcacacctccctctaagaaggccaaaacccttactcagagtaattggcctacaatttcagcctcttttctatggagtccttcggttctggaaaatactcctgagattgatgaatagaaaagaaacaagagcaggcaggactctgggccatctgcccctgcttcatttatagaagccctgcttttacgtttcatattctagatttttggataagtttttttttactttgcatttttgcattggctattttttaattgtatctctttaaggtatataacatgatgttttgatatatatacacatagtgaaatgattactgtaatcaagccaattaacatatccatcatctcacactgttactctttgtatgtgtgtggtacaagtacctaaaatctactctcttagcacatttccagtatacaatattattaactacagtcctcatgctatacagtaaatctctgtgcttacgtgtcctacataactgaaattttatactctcgttgacctccatctgcccatttctcccacacccttcattcctggtaaccactcttctattctctgtttccatgtacttgaagtttcatttcgttttgttttgtttagatcctacaaataagtgagatcatatagtatttttctatgtttggcttatttcacttagtatcatgtcctctacttccattcatgttgttacaaatggcagtaactccttctttaaggctgaataatactccattgtgaatagagacaccacaatttctttatccattcatctatcaatggacacttgggttgtttcattatcttggatattgtgaagaaaacctctttctttttgctctttaaatatataaagagccatctctggtgcaaattccaaaagaaccgcccatgaccaagactattcctgctggatcacacctcatcctttccctagctcccaacaatgacatctagaatattatactgaattacatttcaggcctttgtggtctagcctagaacttaaatgtgccttaagatccaaacaagcagcttttaaacaaacttttggaaaatgctctctattcataaatggaagctctctgtgcctacggaatagaagcaaattcatttattaatagtccctaggtcactcataattagtgcaaaactagtctgttaactaggcaacccctgaggcttcaggaagtaattcatttatgtgtttgtttttcttcaatatttatagttgttgtcttgcacaaaaatctatctcacagagatgtctgaaatctcttcactggtcattaactactctgataaacattatttacttttctcttaaaacatataagagaactagagaaattctgaaagtaaatgagatagcacaaaaaaaagatgaaagaacactgaagataactttggtatattttataaatcttcccagagtctcggcttatagctgggtttaatgccttgacacatacatatttatcaaaattggcagagtaataaaatcaggtgagataaaaactgacatgaacactacaaatacaaacttactatagcttttttcaaaattatattcaaaatggaagcatctaactgaaaattgttactttcattgtacacaaaatgagtatatgtgtatatgggtatatgtgtgtatctctcaaatgcatcatactagcaaatttgagcaatgtttttcacattctcatttaaacataactaaagtcatcctcagtggctacctaatcagcctaattactctgggaattactattaaactagtgaaagccacacaaaagattggtgtaaactattccagattcaaataaaacatatcatttctatttttccattcacagctgccgaggaacaactacacagtcagcagctactagaataaaatcttacagtccattcaaatctaaaaagcaacactgtgcttatttaacaaacaagtatgctatttatctaccatactagtgcttagaacaaggacggggagccattttggctataaagtttagacagcttcaagatgaaggtctgagctaagccttaaaagataggtagggatatagaaaggagagggaagaggagttctaaacgaggacataaagtttgaaaattaaaagttaaaaaaaaaaaaaaaaaccctgaaaactaccatccagcaaacagttttcccaaatgcagagttcttagaagagaatgatgggaaataagattaagtaggtgaaacttacactgagaaataacagaaatatttagatagaagtacaatgatggaaggcataattttttcagtgtacatgtgcatattaaatagcaacacatataaagctcttagcacagtatctggcccataaggctaaacaaatatttgctattattgttgttattattattaactgaaaatttcaaatagtattttctgtagtttggacaactagtaaatatgactaccccgatttttaaaatctagaattaaacatttctatgtacttcttaattttatatacatgatctcaccacaaagccctcaatattactcaaaaggcacatctttatttccctgtacttcaaatcaatttctatctaaacagaaattcagcttggtctttccccaggcaatgataaccttctctgacactctctaatgctgatgtcctccaaacaggactttctgtcctccaaaaagaaaaaaccttccccaaggaacagcaagaaagaaggaagctttataatagatgaatttataggcaagtctgtctcttatctaacttctgtgagtgtccagccctgatcctgtgtctttggtttaaaagaaaaaaagccctgggtaagccaagctcagccctaggcatcctcctcttcttcctattttggccctggcttccatgaccctatctgttttctgtaatttgctacatataatgggtaaatatggaacaacgatgaagaaagcaaagattggaggggggaggttgccaaactgctctccgctttagccccgactttgatataagaaggcaggagagccaaggattaatatcagaggtggtttttcatttttcataacatttcagagcctgaaagactgtaacaagatggtgatgatgatgatgatgatgatgacgacaacaacaacaacatttcacatttatttaggctttcactacataatcgcaaaaacactatctcatattaacaagaataacagctacctggagatcaatgagtctagtcctctcattttataggttagacaacttaatgaagtcagagagattaataactttgccaagactacaaattagtggcattggtgataataacagtgatgataataatgatggtgatggtggcagtgattacgttaataacccactaaattctttgtgtgccttgtctcatttaatccttacagcagccctaggagggaagtactatatttatcttaattttaagctgaagcaactaagaatttaaaagatcaaaaaacttgcccaaagtcacacagcaaataagtggcagaactgagattcaaaaagcagatggactcaaaaatctgtcaagttaaaacactaaactacacttcctgtagttaaaattacaactcgattcttctgactctgatcctagtttaatattgtttccctcatagcctgtctcctaaatttagtgaggtatgtgttgaaatagaaatctaatacgtattgcatttattttctaatatattatctgttacccctacaagtttaatgttacagaatatagatccatctctagctgtaaaaatatactaatatatattattaagtaattagcaatagtattcattttatcaatatgacatttaatcaattttagtttttataagtcagatgcacatagtttatttcaagaggaaaaaaagtcatctcactgttatattcttgcagaagattgccctgtcctaaaatcaggattatttgtagacaatacaaagcagctaaactagcttctcttagaatttccactgtaggaaataaataacaatatacactaagttaaaaataataatgcccttgttatttataatctaccctcagggaattttaaagcacttttcatgtcgtaacagtcttaaaatgtttccaggatatggattggcaaaccaaagtactgtaaaaagaattgtgattttttttttttcttttagatggaatctcgctttgtcgcccaggctggagtgcagtggcacgatctcggctcactgcaacctccgcttcccgggttcaagcgattctcctgcctcagcctcccaagtagctgggactacaggcacctgccatcatgcccggctaatttttgtacttttagtagagatggggttgcaccatgttgaccaggctggtctcaaactcctgacctcaggtgatccacctgccttggcctcccaaagtgctgggataataggcatgagccaccactcctggcataacagtgatctaaaaatcttctatatggccatgtgctgtggctcacgcctgtaatcccagcactttgggaggccgaggcaggtggatcacaaggtcaggtgttcgagaacagcctggctaccatggcaaaaccctgtctctactaaaaatacaaaaattagccaggtatggttgcaggtgcctgtagtcccagctactcaggaggctgaggcaggagaatcacttgaacccgggaggcggaggttgcagtgagccaagatagtgccactgcactccagcctgggcgacagagtgagactccatctcaaaaaaaaaaaaaaaaaaaaaaactatgtgaagtagctccttgcacacaatagtgacaaaaatatttagcatttattcaaagagctataatttccagaactctttcaattcttaccctaatcctgagaagcaagcagggaagattacattatccccacattaaagttaaggaagaactatgattcataatggatacttgtctcagccaaaatcacagtcaccaagaggcagagccaggattagaaccttggtcttctgactcgtgagtcctatatacttgctactctacttgatctttatttcttatataaaagaatgttcagttaatgtttgacaaatgaacgtatgcaatgcatgagcaaatcacatttcatcagaaagaaatgctgaatttctaaatttcagaccagcattttgccattatataattttttctctgtaactatactttttgtttctgaagaatgaggctgtcccctcaacaagtataattatcctctagaaaagcaaattgtctttgagctgataagctgataaacagctaacacacaaaatcactaaatttttctagataaaaatcacgagttaaaaaaatagatatatcttcttagaaatataccaagaaaaccaaatgctataacttttaaccctagtttatagcatagctaaagaacaattactatataaactagacacagttttggaatgaatgaatgaagactcatttataccaagaaggaagaaaagaatcacaacacagttcacccatgatttcacatctattaagtagaaaatattatcatattctcacaactgtcagcctgtgctgccagacttcacatttagcaattatctcaacgccagctgtccccacaatttcgtttcaaatttaatatgccctagaaaatattacatttcaaaatttctagcaatttgcaaaagatagagacagaagaggcagcctctgtagcaaaggcatgtgtaggctctctgcacactgtgggaacacactggaatcctatagtggacatttgttatgtgccccccaaccctctccaggattattctgggtcttctggtacaactccaaaacctcatttagataacacccctcccccattctcagtccatgtagactggatgaggtctccttactccactcaacaaagccaaaaatgaacataagactgctgatgccaacatcagtgctttctactacattatgcttcatattacagtgacatttattgttttgtctgcctaacacaacattcccttcttatggaatggcaactaatggctatgtgatcaagctgcctgggtttgaaacctgttcccaccacttcctacccatgtgacttgatccatttatttaactgctctaagcctccatttcctcatctgtaaaacaaagattcattcacatattcaacaaatatttattgaacacttattatgatccatgcttgtgcaagtgctgagataagaatagtgaataagatagaaaaggtcaatatcctcatggagctcagatatggcagtaaacaacaataaaccaacaagagaggtgcagattataagcgccataaaagaaataaataatgggagaagatagtaaaagagtgattctagatccacttacatagaatgtgcagaatttcaggataaagaggctttcagtataaagcctctctgaggaggtgacattttagctgaaatataaaaagaaagaataagccaaccactcaaagagaactggaagatcattccaggaagagggaaagccagaggaagaaaagagcttggcacaaaaggacatctagataactgaagcatggcaagtgagaagggggtaaaataacacaagacgacatcagaaagctaaacagaagccagactgtgctgagccttgcaggtatgggaagaaattgagatttcattctaggagcgagcaacggaaatccattgaagtgctttatttaaagctttgtgtttttaaaatgttattccagctactatggaaaggatggatatggaaaagaagagtcatctattcaatatagttaagaggatggatggaagagggaaagaaggaaggaatcagggatgatttctaggttacttgggttgagcagctgtgtatatggtgatctattgattgagactacaaagattaggcaaaagtcagggttcaagaattattacatttgagatgcctatcagatcctcaaaatagctgttatacacttttttttttttttttgagacagagtctcactctgtcatccaggctggaatgcagcggcaccatctcggctcattgcaacctccacctcctgggttaaagcaattctcctgtctcagcctcccaagcagctgggactacaggcatgcaccaccacgcccggctaattgttgttgttgttgttgctgttgttgtttttagagacagggttcgccatgttagccaggctggtctcaaactcttgacctcaagtgatccaccctcctcggcctcccaaaatgctgggacatgagccaccatgcccagccctgtgatacatattaaatgaaataatctatgtaaaaagcacaatgcctaatgcagagtaaacattcaataaatgttagctattattcatgttttgagaaaaagaggaaagttccttccttggtctacccatgtggttttggtaatgactgatgactttatcttatcccatgacccagctagggcattggacaactaactggtctagatgaaaccaacaagaatcacactctcttagctgtggtgattggtccatcactcaagccacaccaacttaagttcttccctatgattttcaaactagaagctgaaagggaagttccccttcctcttcagtagggaccctgtaagagtccagggatgctgatggtaaagttcctacttctaggagaaatgccctctgtaattggagggaataaggctgatacccagagagaagcacagatgagagacagagtactagaggcagagagtgcttatttctagtaattctagggtagtgctgtccaatagaagcataatacaagccacatatgaaacactaaaaatagacaggtaaagttaattttaataatacattgtatttaaaccaatgtatccaaaatagtatcatggtaatatgcactcaatatacaaagttgccaaataagaatgatacaatggactttggggactccggaggaaaaatgggagggggggagagggataaaagactatgaatgtggtgcagtgtatactgctcgggcgatgggtgcaccaaaacctcacagatcacactaaagagcttactcatataacctaataccacctgtaccacaataacttatagaaaaattaaaaataaaaaaaaataaaaagttgccaagtgttcaaaacccagtgtgtatggtaaatttgaactcagactagccatatttcaagtgatcaagagcgatatatgactagtggctactgtgttggatagcactaccaacactacctgggctctacccaggccctttgcaggccataagccaatgcatgcccttgtaggatttcattaatttaagttggatttgtgtctcttatcccgagagtccttaatttacctaaaaacattatttcacttattccatttacatctgaaaccctaataattctttttttttttttttagatggattcttgctctgtcacccaggctggagtgcaatggcatgatctcagctcactgcaacctccacctcctggattcaagataatctcctgcctcagcctcccaagtagctgggattacaggcatgtgccaccatgcctcagtaatttttgtatttttagtagaagaggggtttcaccatgttggccatgctggtctcaaatgcctgacctcaggtgatccgcctgcctcagcctcccacactgctgggattacagacatgagccactgtgcccagcctaatcatttttttagaaatcacacacagtacattatattctgaaaattgattcaccaattcttattagcataaggactatcacctatttccctacttgagtgccaactcccacttcacatatgcactacagttaagactcattagacctctgtattccagccttgattagcacaagaaaccataatggagcatctgcaaacaagaatcaaaggtactacaagtgataactctgattgagttgatctgaggtggaatctgggactccatttttttaaatgttgtcctagtaattttgataatcacccagattcaaaactaccgagttggatcacttactaaatctaaatagcaacttctgccccttatttaccttttctattgttacaagtatttcctctgttgtatttactgaagcgcatactatattcacctttgtatacttaattcctaaccccttaatggatatacttcaaatattcaataaatatttgttgaactaaaagaaaaacttaaagtggacttttaatatgatgctatttccaatatgatatctaaaatagtccagagaagtagtgggagataataagagtactaagtttaggtaatggcctatctctccttctttctgttctaattttaattagctctctgctagtctgaattgagggtaaagggagttaattgttggattactctgactacagttacattaaaaagaaagtgccctgtggccatattaagtgccatgttgtacccaaatgtccacctgtagttagataattttgatttaattgacttcactcacatccagagaccatggaagggagtggaagtttggtcaattaaaaatcaagcattaagaatgccaactgattcctcctgagtgagaattagagaaaaggaattctaggtctgtgggcacagggaaagacataccaaagcattcataaatggctcttggttcctcacctccttcttctcttccacacacacattctaggaggttcaataaagtgctgtaatgtgttttgcacacagaaggtactcaacaaagttgtatcagttgctggggccataaccaagtattacaggctgggaggcttaaacaacagaaatttgttttctcacaattctaaaggccagaagtctgagatcaaagcattcgagtggttagttcttgctgaggcctctcaatctggcatgcagatagctgctttcttcctgagtcttcacagggttttccctctgtgtttgtcaatgtcctaatctcctcttcttatagagataccagtcatattggattagagcccaccctaataaccccattttaacttaattacctctttaaagaccctgtctccaaatacagtcacattataaggtagatggggttaggagagcaacatatgaatttaagaagacataattcagcccataacaagtaccgtctaggtaaccactctaacagaggttagatgaatccaagaatagctgaatcttgaagaggtcatatagagttatttggtttcagggatatgttaaacatgaaagatctaaaccagcggtttcaaacactactgttcaacagaatcgattatggggtatgttacaaattatgggtgttctggccacactcagaaattcttaggagtagaccaggcatctgtatgtttgcagcctggaacaaagtctggtattgaccctaaaagacatgtcaacctagacagccagcaatgaggcaagaagcaggactggcaatgaagaggaaaagacctcacgtgaataatgtagtgatctgtatcgctacattctcttcatcattaagtctctgttacccaaaattcactctaataccatattactctctttgtgactttgtccaaacaaagtcttcccaaagacgtaatgcacaatgagaagtctatgcttatgatatttttcagaggagggctggttagaatcacaaatgatgatcatttacttcacacctaatataactcattctccgctgaacggaatttggttgattgactgatttgtttaggccaatggattcaaggaagtgggccatattcatctcatcttcttctcctttaagctgcctctgggacaagttgacacacattttcaccactctctagtctcatggttgattaataatatccgtataattatatttcatcctatcattaaacagtactggattcaaagtaaaactcagtgaaataatttggcacaactgcttttaaaaattatatttttgtattttctccttcatatgcttctttattctatctctgccttccattcaacaaatatttattgtagtgccgggagtatgggaatataacaataaataaaacatagcctctgcccttcagaaaagtaaagtctagaaaagaaaaaaagatgtgtaaacaaataaccacaagagaatgtgccatattataacaaagatacacataaggtcccatggagcacagagtagagaactaacattgcctgaaggcagagcttacacacaaactgaaggatacagtcaagtatccaggcaaggacacaggacaagaacaggcattaaagcaagaaaatgcaaggcaagtttagggaacagaaaatactcatgatggctctaacaaaaggcttgtaaggttgggactcatggtgggccttccatgctacactaaataaccagcactgtcaggggaagtcactgatagttttttaagcaccatcagttctgtgtttaatttcccccaggcataaaattttcctgaggctgtctgctgctccccactccccagcgtgcgcccctcttccacagccccatgccgcctgtgctgtagcaatcagaagtacttactgttctctaaatatgccaggcatgttctcactgactgctaatgtcaaaagcatgacttgaaaaacatctaaatgcatgatcagaccagtgatagcaaccctatggtggagttttcaacagttaataaggggagcaatattgaatcattccagttctctatattttgtcatttgctgttcctgctgcttcatggaaaagggttatattttctctgtaaatagaacttgatatatcttcataaccgtcagcagggatggacactgtgctacttcccagcaaaaggtgaatgaaaagtgatagcagttaaaatggtgttctttgctgtttctctgttttgttttcatactcttcttttaaaatcagactgtaattttaacaaggtggcaggtaaagcattcctttttgcttttaatgctgcctggaaataatttgttttctcctctccagagaaattcttaaaaaaaaaaaaaaaaaaaaaaaaaactgtaaaaacctgactgttctgatacaaaccttgttaataggatgttcaccttaaaactaacccaaaagaggaacaagtaaagcaacatgataacaaatcacagaattttagaaaggactaagagcaaatgtagtggtgtggttaaaagctatggttcctttgaagctcaaattaagaagaacctgctagtactgatcatctagcatcctaagtgggaacatagcaaatagacatagaattataaccctaagagttgaaatcagaataatagcaccaatgaactcctcaaatcattttttaaaggaatatatttgtgaggcaatgcaagtgaaaattacataatatacagttactaaattcctgagagttctatttttgtttattcaatatctactaatataaggacaaaaatcattgctaatgatcaaaagagcatagcaatcattatcaaattaagaggccaggcatggtggctcatacctgtaatcccagcaatttgggaggctgaggctggcagatcgcttgagctcaaaagttggagaccagccagggcaacatagtaaaacccatctctacaaaaaaatataaaaattagccaggcgtggtgatgtgcacccattgtcccagctacttgagagtctgaggtgagagaatcacccaagcccggggaagtcaaggctgaagtgaaccatgatcacgccactgcactccagcctgagcgacagaaagaaaccctctccaaaagaaaagaaagaaaaattaattaagatgtgattcaatacattttttccaattctttaagttattaagaagccaatgtcaatctctcatccactgcaggaatctcctagtttccctaatatacaacttcggtctctgctgaaatattaccttttttatcgtaaatacttaaggtatacaacatgatgttttgttatacatatacatagtgaaatcattatcacagtcaaacaaattaacatatctgtcatctcagataccttttttccccctttggtgataatctactctcttagcaaatttctagtatacgatgtgatatcattctgtacattggatctctagacatgctgtacattggatctctagacattcatgctacataattacaactttgtaccttttgacatacatctccccattcctgtccctccctccccaccccaggccctagtaaccaccattctactctgtgtctatatattcaactttttttttagattctgcacataagtgagatcatgcagtgtttttctttctgtgcctggctttttcactcaggatactgtcctccaggtttatccatgttctctcaaatagcaagatctccttttttaaggctggacaatattccatcgtgtgtgtgtgtgtgtgtgtgtgtgtgtgtgtgtgtgtgtgtgtgtgtgtaccaccatttctctatccattcatccatcaacaaatgcctaggttgtttccattctggaccatggtagatactgctgcaataaacatgggagctcagatatcttgacaaggtgctgacttcatttccgttggatacatacccacaagagggactgattgctgagttatattgtagtcttatttttaattttttgaggaacctccactcagttttccatagtggctgcactaatttacatacaaaagtttcctttcctccacagtctcaccaacacatctctttttggtttatttctgaactctctattttattccatctgtctatgtgtctgtttttatgccagtaccatactatttttccatattataactttgtaatatagtttgaaatcaggaagtgtgatgcctcaaactttgtttttctttctcaagattgctttgcctatttggggtcttttatgtttccatacaaatattttctatttctgtaaaatattacctttgcctcttcttttcctttcttcccatgtcatagttccctttctttttcttccctcttctctctatgcttctcattctagatcacatttgggtaatgttaggtacatgtatatagtgactatttctcctggaagatgatttagactacaactacaactataatcacttagaaaagtgtagaattcctctgtccacctagaatagagctgaatttgttcatattccattccaaacacagcattctaggaaactatgaagtattctgcaagctgtaaaaagatccatataatagaatattatttgccattaaaaaggaataaagggccagacgtggtggctcacgcctgtaatcccagcactttgggaggctgaggtcaggagttcaagaacagcctggccaacatggggaaaccccttctctactaaaaatacaaaaattagctgggcatggtgccccgtgcctgtaatcccagctacttgggaagctgaggcaggagaactgcttgaaccagggaggcggaggtcgcagtgagccgagatcgcaccactgcattccagcctgggctacagggcaagactccatctcaaaaaaaaaaaaaaaaaaaaaaagaggaataaagtacagatacatgcaataacatgggtgaattctgaaaacatgctaagtgaaagaagacagtcatataggccacacattgtatgattccacttatatgaattgtacagaataggcaaatctattgaaacagaaagtagattagtaattgtctacactggggagatgggaggaatgggaagtgactgctaataagtacagtggcttctttttagagcgatgaacatattctaaaattagactgtggtagtggtttcacaactctgttaatatattaaaaaccatccaattaaaaactttaaataggtgaacattatgagaattatatctcaataaagctgtttaaaaacatgtatctaacgcaacagtctatgtgtacacacccataatatatgcatatatatacatactcatttacagagagttctgaattatcagcctgcagtttatccactgaaattttaaaattcaaaatttcttacttccttgattgtatgagaatggtaataataacaataatgacagcaataataatatcaagtactcatttagttcatactatgtgccagctattgtgctaaaaatacgtaatcttattaaaaccttacaaagtcaccaaataatagagtctgttactaaccattttaacatattattttttataatcctcacaacaagaactacagtttttctcaatttatgagaaaactgagatttagggtggtgaaataaatcattctcggttttacagctagtagttggcagagcaatgatttaaactccggtcactgcactctgctgccacttgagctatccctctgtaagggcaattgagtctcagtgagctaaaagaatcttacattacttttgcagacaggcatctaacagagtaggaaaaatcccagaaccaaaagctgaaacccagaccgcagtctgagtcatgatacaaactaaccaggccagccaaattccaatcctctcatctacaaacatggaaattggaatagaaatttttcaaggtcctatcagcttaaaagtccatttgtccaagaaaaacttacttaaaaatctgagtcttcagtccaaaataaacttgccagaagaaatgctttctttattttctgccctatgagtttacgactattattaggttgtaaaaatattaagtataactggaaactgaaagcataattaacatttacttataaagttcgatatcacccattagcaatataacacataatgatttattaactttttactataaaaacttttaaacatattcaaaagtagacagaatagtattaaaaaacccaacgtactcatcatacacctttaaaaatcgtcaactcatggtcaaatttgttccatctatataccctcccactttgaagaaaatccatggcatcataacatttctgtaaatatttcagtatccatgtgtaaaagataagggttcccttcttaaaagtataatcatgataccatcatgacacctaaaaatattaacaataatatcttaatatgacaaacttggaaaatacatttagatatataaatggcaataaataatacagatttaagtaccactttcactgatattaaaagataaacctaggcacattaaaattttaaagagtttatttgagcattcagtgattcatgaattaggcagcaccagactgcaagtgatttgggctccaccaaaggcgtgcaagggaaaacttttataaggtgtctgtggaagcaggacagagaaaatgtttgatttattaaagtggagagtccctacttagaggtaattggcagtgtctggtaaagactctagatagagattcactggtgctttctgatttgttaaacttaagtttcatttcactgttttacagtgtgtttactgtttacagtgagtttggtttcagtttgcttacataggaacccaaagcactacctaatggtttcccaatcaatttttttttttttttgagacagagtctcactctgttgcccaggctggagtgcagtggcataatctccactcactgcaacctctgcctcccgggttcaagtgattctcatgcctcagcctcccaagtagctgggattacaggcacacaccaccacgcctggctaatttttatatttttagtagagacagggtttcaccgtgttggccaggctggtctggaactcccggccttaagcaatctgcccgtttcagcctcccaaagtactgggattacaggcgtgagccactgcacctggccccagttaatttttttaacactgacaaattttactttgagtgttaaggctatctgtatattcaaattttccagactattatttctatttgaatacattatttatatatataatctattatatctatacctaatgtctctgtactctattcatgaaatgtcatatggcactatactgaatgtgtccatagaagtagagtactaaacattctatatatactgagcttattagttttgtttactcattgagcttgcctggtattgaaaagaaattaaattagttaggcatggtttgtttgtgattaacctttcctgtcttccacagttcaatttatcatcctcttcgtgataccaaatgactactttatgaattgttccacaaatttgccagctattattcacgagctacatattttatccaactgaagtgtttattctgtgacccttattttcatataactctctataaccattttgcttctaccatacttactctcacattccttccctagcttgccttgccctccaaaacaaaaaagcttccaccatgaaattactaattgatattctgccttataaactttgccttgaaagattcctttgaaaaattaatttcatttcctcgatctagccaatgataaaataatgatgacagcaaacagaagtagaaacagcataattttttaaaaaaggaaacatcaaattttgtattgaaaatttacatcagcatttcactagtgaacagacatttcctctgagaaagagtgataattaccatttgcacctcatgtaaggattttcctgaggcctaagaaagctataaataatatagtttcttttgaaataaagaaaaaaaatttaattttctttcatcacgctaacaagaagtaaaataggttgcaaataatggtgtagtaaatggattaaagagattagcttcaaaataactgcactgcaggacctaaatgctgaacttgggttatccaggctaaataaaggccagtcatcatcttatttttatagttcaatcataagttagggcttatgggagtaacgcaattaagaaaatatatatatttgggggagttggaaaagtttggaaaatttcaaaaatcaaatcacatttcaaatggattaggagaactcactaattaaaggtggatagatttcatactgttaaaaaaaaaactcaaacaagtaaaaaaaaatttatgattaaccaccaatacaaacaataggcaaatttattagtttctctgctcttgctttacaactgtaacctttataacaaaccctgttagaccttgtaggagaccctgttaatgcccacaccatatccccctgacttgtctgtgagttctcttccactgctgtggatagtcatgctgatgctgacagcttcccacctaaaggacccacagttctttctccattttctctttattcttcctggaaccaccttgcacatacactacccatgcctaagtccttacaccagggtctgcttttggggaaaaccctaataagactgttggtaatagaaatagcactagaaagcagaccttcagaatgagattctggaattgcattacttgctggtcagagggcagcaaggatccaatttctagtgataagtgagtggtgataacccctaacaggctacagcagtataatgcccaaaatttttaactgaggtggactgtaatgtgttacaggaaggaggaagtacaagcttatataatagctctaatacttgaaagacatgtggtaatcaaaacaaagattttggagtatgtgttaactactcgagaagctttgaagaatgagaatggcaggcttgggtaagccatctatcaattcagggcatgctgtaaaagtcagaaaaactccatgtcagtatttaaaatgaaccttatctctggcactcagctaacatactatactgaaatcaggcctaagatttgatgaaggagcttagctacaaagacaactaaatgcacagccccagcaggtctcccatcagggctctgatagggaaagggggagggtggtgatgcatgggagggtgatatttaggggggtgtacatgagaccactaaacactcaaatctgctgaaacctctgggccggcagaatccaccctcatccctttcataaaggtaagccacctctaattgcatggagacctggcaaaggacatacctgacgggggtgccttcctccagatctgcccttcatctttcattgcctctagaccagtaactagggtcaggtcctactgataaaagctccaactgtaaggcgcagtggctcacacctgtaatcccagcactttggtaggctgaggcgggtggatcacctgagatcaggagttcaagaccaacttgaccaacatggtgaaacctcatctctactaaaaatacaaaattatctgggcatggtgatgcatgcctgtaatcctagctacttgggaggctgaggcaagagaatcacttgaactcgcgaggcggaggttgcagtgagctgaggtcgcaccattgcactccagcatgggcaacaagaacaaaaagctgtctcaaaaaaaaaaaaaaaaaagctccaactgtgaagggcacaccttcacattggtgggaagaatatgggaagaaatcacctattcaccgaaaaagtcagctgagcctatctgacatgtgtcattagaactgagagcacacataaggacgtggatgttgagggtgctgagctgaggcatggggaaagaatgctagatagaggagagtgctttcatatggaggcaatctctggtgattcataatttaatttgtagcaaggaaatcataagtaggtcctaaaacactaatgggatgtcaatgtgactgacaggattccaaaataacaggcatcagaggtggcacttagccatcagaagcaaggtgaatgcacgccattaaaggtagtaaggtcagagcagtaaccagagagcttgacctgcaggggtctgtggcaatggttgataagtcattagccattttgtttatagaagcaaaagagatgggtaatgtatttgttgctagggctgctgtcacgaactaagtgacttaaacaagagaaatttaccgtctcacagttttgaaggccagaagtccaagatcaagacattgttggttccttttaagggctgggtgaatctgttccatgactctctcctatcttctggtggttttctggcattctgttgcgttcattaacttatagaagcatcaccccaatctctgccttcatcttcacatgacattctccttgtgtacatttctgtgtcaatattttctttttgataagaataccagccacattggattaggggcacaacctaccccagtatgatctcatggttactcattacacaattcaacctatgacaagtagttaataaggttaattttttatttatatttgcaaagaagaccaagaactaaacagaagatcgatgttccttttctggatctaaggcagttctcagacccagagcccatcaaggggaggctaagtcctcttgagcgaaagagctaatgtttctccaataattctttaaggggaagtgctgccatataacagagtatatggcaccatatgccagtatatacactggtgaaagtggaatacccaaacctttcagggctattggatataggctctaagctgacacttataccagggtatccaaaatagctttgtggtctcccagttagagtaagagcatttggaagccagataataaatggagccctgactcaagtccatctcaccatcagcccaatgggtctccagacccaccaactggtcacgtacctggtccctgagtacataattgagatggatatacttagaagcagctagaatccaaacactggttctctgaactatgaaacaagagccattataatagaaagggacaaagaaagcccctggtatcacttctgctctgtccctggcccaaataataaatcagaaagaatattttggccaggtggaataacaatttgtgccaccctcagaatgcttcctgcaaaaaaaccatacggctcatggatgagtcagctaaatacgttggtgcaagaggaaaactactgtcacactatagcccaaggcaaggatgaactactgcaatgttactcaaagtgtaatccatagactagtgccaattcataaatttatttttgtaagtcgacaaaataattattaaaagtgagagtacatatttggaaacattagagcaatttgacattgctgtaataactgtagttttatattttacaaaaagatcactcatgttgaactgaaaacaaacccatatatagttccttcacatgatcagtttgagtagcactgttctaaaggacagtggtgaaaggaaatccatcaggcagagcttcataactttacatgaagaaagaagtggtttgaggtgagaacaatatcaattgttgggcaggggctagtggttctgctaattgatcagatgcctggaagaagcaatacttcatgatcagatacaaggaggtctgagaaggaggcatgtggatgaccctataggtgtgaatacctaacaaagcatctatagtagaggcagcattgaacaaccagatggaaaagatgacccatccaatgaatgtcagccaatctttgtcctcagccatcacaatggttgcacagtggacatggaaactgactagccataatgtcagggatggaggctatgcatgggcataaaagcatatactccctctcaccaagggtaatctagctattgacagtgctgaatgtctgaccaataagtactggcccaaagtggcccctcaatacagaaccatccctcaaaaaagccaatcagacatttgtggcaggttgattacatcaaattcctttccaccttggaaggcacagcaattcatcctcaatgggcctgatggttattcaaacatgcttttgccttttttgcctctgccaggtcatatttactagcataggatccaccagtctcaccttttatggccattctagcactccatcaagctgatgaaccactagcattccatcaagctgatggccaaaaggctcagctttagaataactgtctaaaggattggtgccccatcctcttaaacagaggtccccaatctccagcctgcagagaggtaactctccatggcctgtgaggaaccaggctgcacagcaggaggtgagcagcaaggaagcaagcattatcgcctgagcgctgtctcttgacagatcaggagtggcattagattctcataggaggtgaactctactgtgaactatgcatgcaagggctctaggttgcatgctccttatgagaatctaatgcctaaggcagaacaatttcatcctgaaaccaaccactctccccatcccagcctcccacctctgtccatggaaaaattgacttccacaaaagcagtctctggtgccaaaaaggttggaactgctgctctacagcgcagtagatgagtcaaaccaatgatcattacacgatgttctgtccccttagcatgggtgtgggaactaaggggtagaagtagaattggcagcactcaccacttaacccacttgggaaatttgtccatcctcagtagccaagttgggtaatttgtacttcccgttctctcaacttcagactctgtgggatgtgataccttaacccctatgagtggaacactttcaccagagagtaaattactttcacccaaaccctttattttggtgcctgatttaaaagagaatctgagttaactttaacacagttagatacaattattatcaccttatattgaggaatgaggcacgaggaagtttaagtggaccagggtcacacagctagtaagtgatagaatcagaacttgaccctgggcagtctcatctagagtccttgctttcaacctctactctaaattatctgtttttaaagttcatgtttttgtatttagttgtcttggagcaaagcattcctatattattttatgtttctaaggcaggtgtggctagcacctctataattaaaataaagttcaattaaatctgaacaagtattatttaatatagttttttattattttaatacaggtttcaatgtaatcagacagtaacaatgtctagctctgtcttcatttagcatgtatctataaacacgctccttaaaaacatacctaaacacacacacaaaaaaagatgtctttataacaaattttcacaagttatgcatttttgaacaacagttaacaggataagttcaaggtaacagttgccagtgattttcatccctaggaagtaggtaaatcaaccaggctaggagttttcaaaaataaacataaactcctttgtactagctaatccttatcatttagcatcacctgtccttcagctggccctatgcttgaggcatcagaatgaagccctgggaactagtattcaaatcacaattattttaaagtttacaatgggcaatttcctaaaagtgatatgatagaaagagtatgaattctggagtcagacaatcccagttttgcaacttacctgctatgtggcctaggacaagttatttaacttttggatcttcagttttccaatatatagaatgtggaagaaaaaaagattgaagtatgcaaagtgcctagtgtaccatctagcatccagcagctacttaataagtaatagtttccttcttcataggtattattaattaattcatgtttacataattacttgcaactaaaataaacaataaataatgtagaaaatcctaagggtcttataagtttagatggaaataaattggaagcttgcataaacagattaaaacacagattcacaagaagaggaaataacaataatagattagaaagcaggtagacccagccataggaaagaaaacttaaatactactcagcaatatctccaggataccatcagaactgttttggtcaccccataggggtagacatggatatccactgctataattttgcactgtactaacatggtagcctctagccacaggtggcaaattgagcacttgaaatatagctagcccaaattgaaatgtgctgcagagttaaaaaaaaaaaaaaacctggatttcaaaaacttggcatgaaaaaatatataaaatatctcattaaaaatgtttagattgattacatattgaaataatatttggatttattgtgttaaagaaaacattgttagatttaacttcatttccctctttttactttctttatggtggccactagaaattttaaatttacataagtggtttgcattttatttccactggacagcactaatgtgaggtcctaatttaacttgaacagcactgatgtagagtcctcattcttaggctcccatgttcttccctcccagtcttccattctttagcaaagacttagcactacagtaacaacaattttcattcatgtccctgtatgagggccccactatcctggatgcaacacacggatgatttgccacaaatagtctttaaatgatttataaaatatataggaatgaataagcggataaataactcccagcgaaaaatgtccctcaaggacaatattcacataggcaagactctgtggtactttctaacacactttaaaaggaacattattttaatatgcactatccattcacgacattcaagacaagtgaaggttagctgtctactagaaaaaataaaattttaaacttgaggcatttattcatataatcaagagtctaggaaaactgcctgaattagtcaaggttctccagaggacaaaaaaaaaaatgcatatatacatatatggagatttattggagaactgactcacaagattatggagactgaaaagtccaccaatgattaattcattcattcatactttacatagtttaaaagtccctggcatcaagcagggtacccaggaaagccggtggtgcgattcagaccaaatctaaaggcctgagaactagggaggctgctggtgtaaatctcagagtccaaaggagttcaaaggcctaaaggaggcgctccatgtccaaaggcaggagaagatgtcccagctcaagaacagaacaaatttgcccttcctccactttcttgttctattcaggccctcgaagccagactgaatgacactcacccacatgggtgaggacaatcttctttactcagtcaactaagtcacatgttaatctcttccagaaacacactcaacagacagacctagaaataatgttttaccacttatctggtcattctttagtccagtcaagtttgacacataaaattagccatcacaccacctcaatcctctacacaaatttggctgaaactagcttgataagtctttctatcagaggcttcagtggaaaaactgaccaggtgatatggtttggctctgcatccccacccaaatctcatctcaaattgtaatccccatgtgtcgaggaaggacctgtaatccccatctgtcaacagaggaaggtgattggatcatgggggtggtttcccccatgctgttctcatgatagtgagtgagttctcatgagatctgatgcttttataaggggctcttccccctttgctttctctgtctctcctgccgccttgtgaagaaggtgcctgcttccccttccatcatgactgtaagtttcttgaggcctctccagccatgcagaactgtgagtcaattaaacgtcttccttttataaattacccagtctcagggaagttatttacagcagtgtgaaaatggattaatataccaggcaactccacagactctgggtatcttcttcaagtgtttcacaaatacagtttcccaatctttacagaacatgagactccaaaaataaccaaattctcacttcccctgctcacactccccccaaaaaatctactcaccacaaacaaagcaatctaatctgatagtagaaaaatcaaaattaatgaacagaaaaaaatctgttttggagataaaaaccagagaaccactggagaagatgacataaacagtgaaagatcacaggatggcttttcatcttcataactctgccattagtaaacaacacacactaatattttgcttctatgaaaatctcctgtataaattttcaaggaaaaattagtaatataaaaatatgaaaaatataaacttttttttttacttcgaaagtttttaatctcttagacaagtataattacagcaagcacttttctacaagtaactttaagctaatggacatataatggataacaataagcatcctagagtcaagttacctgggttcaagtgccagctctgccacttaggtgctgtgtgaccttgagaaaatcccttaacctttccctgctcagtttcctcctctataaaatgtggataatagcagctacctgagggagttgttataattaaatacattaacatataaagcatttaaaacagtgcctgacacatagcaaaatctaaataagtggtacttattattacaaatgaccaaaaattaagtgacagtaattggtacatctaatctcacctaaatgtcttttcatttaattgatgactgttctcctcactaaggacttctttaattcttccaacaggtgataaattgttactaggtttaagagccaaaggatacatattaaattttttgcaagactcaataaatatggttttatagcactaaacacttctaacaagagtaggaaaaaaaacatttcaggaaaaacgttttgtattaagaataggaaagtcaacagattgataccattaataccaatggacataatacttaaggcccaaaccacaccatattccactagcatttactaagtgtcaattgtgtgactggtgtttccaagatactggacatacaaagaagacaaggactctatccttaagggctcagggtgagtatacaggcaatacacaattatgttatgatgtaaactatggtttgaatgtgtcccccgaagttcatgtgttgggaacttaatccccaatgcaatagtgttgagaggtgagaaattcaagaggtgattagggtatgaaggctctgcccttctgaatggattaatgacattaaggtaggaatgggttactcataaaaagaataagttcagcccctcttaccccttttaacttccaccatgagataacacagcatgaaggccctcaccagatgccaccccttgaccttggacctctcagcctccagaactataaaaaaaaaaaaattcttttccttataaattacttaatctgtggcattctgctatagcaacatgaaatggactaagacaatgtattataacagaagtatgagcaaagtgcattacaggcaaaagaagaaatctgaacaaagccaaagaagcatgaaactgcatagcatatttggggaatggtaactcacctaatatggcttcagcattccatcaagaccttacattgctcttgttttttcaaacattaactacctgtcatgtgcaaggcaccaaagaaacagacatgtaatccatagcctctgggaaggtaatatctgtttcaggtgctaatgtataaatagaagttagctgcaagaacaaaggagtaagagcattctaggaaggagaaatggcatatgcaaaggcattctgagaaccaggaagagtttaacaagtctaaatccacgggaggatcccaagataaaggcagaggtgggatcattagatgttttggatgccaggcttttataacaaaagtgactagtaatcactaaaggatttaaaataagatcatgaccagatctgtgttttaacaaagcccttctgatagaaggccagtaaggagtaatccaggaggtaaaagggataaggaaatagcattagtgatggtgacagaaaaaaaggaaagaacatattcaagagggtcttcgatgagaaaatttggtaaaagtaaggaagaaggagattccttggatggtgccttgagttttttcctaatccctctatccccctagtagaaacatcttctcctttgaacctattttatttctacgttagtggacttttaggggggtacctatttattcatgtctccctcctcctactggtaaactcattatgggcagagactgtgccttatcccccttatattcttagcaggaccagaactagggtgaggagagtgaggcattcaacttcaggttcatgctggtacaaggttgaaatctgtttctatttaaaattttcatattttgttcatcacagactttttgcatacattttgattttttaaacattaaattaaaatattgtatattatttaatactttggcacactcttaaattttatacctgtggcaagtacctcacttacccctagtcaaagacctgatactcagtgtcttcctgacatagtacctaacacaagcaggtacttaaatgcatgttgaatgaaggaaaagcaaacaagtggcataagcaacaagatggatggtggtgggccttttacagagacagtgaatacaggaagagcaaaagactctagaggaacatgagtttataatgcatgtcagaagcactgcttggtgtattacagattaatttattattcaacactggaagcatgtataatggaaatattaaaggatgacattactcaaggaattgttctcaagatatttccccattctctttttaaaacttacactaatatttgaggtattgcagcaatatctaatttcttagttcagcttttaagttaacatttcttaggatgccaagatgagatgcttgttacatatatgtaccattaacactgctatggtatgaatgtttgtgttcccccaaaattcatatgttgaaatcctaatccccaagataatggtattaagaggtggaaccttttgggaagtaatcatgtcatgacagcaaagccctcacgaatggcattagcacctttattataaaggcccccgaaaaatgacttgcatcttccactatttgaggacacagctagaaagcaccatttaagaatcagagagagggccctaccagacacttcccaatctccagaagtctgagaaatgaattgtttataagccactcagtcaatggtatcttattatagctgcccaaatagactaaagacaaacacagtctttgatatgacttcatcaaacggcacccacatcactctatttctgtatccttgctcacttttcttcatagcatttatcactactagatgcagtataagttagttatttttcttccccctttaaaaaagattcactccatgagaacacagaatttttctgttttgttcatagttgtatccccagcacctagaataaatgccattgaaggtcatgacaaagagtgcgagggtggctgggggctggcttacactggagcagaaataagacaaaaaaaataaattaaaccctctgtggatacaaaactagagctaggcgctcacaagaatttaacagaaagccctaggagccaaaaacaaagatgcaattgcaaaccagagcaataagcttgggagcttacctgtagtcaccttgggaagtaaccagtgggcttgggtttaatagcctttggccagatgagattcaaatctctggataaagctgataccctcaaaggattacatacttggctatcactggcataccagaagataaaaggaaacttgcatttctcagcctgggctccgggaagaataaaaaagtctccctgagaattcttaaatatgacctagcctcctatctttggggctttaaatttataccacccagatggtcttggactcccaagccaagaaagtatatagtggttctgggtgtgatagttatcaatgtattttctcacagctcccaatgcacccttctttgtcttgctttatatattggagctggaccctacgagcattttcctttgacttctggctcaatgttaagcttcgtcaaaaggagggacaaggctgatcagcccattgaaaaaaaggtaagtgattccaaacaaactagttttacttattaaatataataaaacataaaatatttgtttctgaaaacctaacagaaagttaatacatagaattgtcatccaatatgaacatttccaatggtagggctggccttaagtcaagcttaatttttcatatactgaaacattacccatctaacatttgaacagattttttatctgattctcatctaactcaatagctgttatctttgaagatttatagcctcacacctaaatggatagcttttaagtagttttttaggccagtgggccccagattcatttatcataagattggttgcctatatatcccatttcacattccaaatatcttcccattttatagaatgataaagggttatatgcattttggatatagtaagaatgaaaatcattgagaaaaacctgggttgccaatttatatatttaatgcttatcagttaaactttaacttgctctatagtaactttaacttgcttatattaggactgcaaagtacaaaacatactccaacccagattctagcaagtaccaccttgcgaaggttaattttatctgtcaatttaaggtccccagatacttagtcaaacattatttggtgaaggtgtttaaatcggtagactgagtaaagcaggctgccctccctaacatggtaagcctcatccaattagttgaaagtctggatagaacaaaaaagttgaccttctcttgaataagaaaaaattcttccagcccaactgcctttaaaatgggatatcagttttttcctgccttctgacttgaactgaaacatcagctcttcctgggtctcaggcctgctggtcttcagaatggaaccacatcgctggctctcctggatctccagcttgcagatcttgcatcctgcaggtcttggaacttgtcagcctccataatcacacaagccaattccttataataaatgcctttatatacatatgcacatatcctattggctctgtttctctggagaaccctaatacacactgcaaatgacctcttattaactcctgctaaagcatcccgcctaaatagctacaaatgttccagacctttccctttctcctctcatttcaaaaggtaaaagtattgtgtttactatcttgtcttctcattgtccccattcccccatgctactaccttgtggaaacacattcctaccccacctctgtaattctgtggttagaacatgagctttgaaatcctgcctaccctctggattacagttgtttggctggatatcctccaagctgagccaatcagaagccataaatgtaaattagatttttgaaatttgtatttagaaactgaaagagagttgattgaagtccctctctgccaacaaccatgtgtgggagttaggcctaagaaaatgaaggagacacactgaaacagaggtaaaagctgaaagaaaaaaaaatagcatcctactgatacctaattccctcatttatacctgaagcttagcctcaccctgtctttccctgacccctttacagtagtcaataaattcccttttggcctaaactggtttgaattaggtttcagtcagtcacaactagagaagacacagtaaattcctactgcatgtaaatcattacagaaatctgtgaattatattaaaaataaccaaacttagttattcaaatgttttctaaaatctgtttgccataaattgatattattcaaaaatatatatatgttccatatttgtcctagaaacattaacattgaagctacttaaaatgcaaagattgcctaggaagaatgtctctttgcttgtttttacaagggacttatcaaattagaaagcaaaattagaaatcataatgagttccatgttctctggtgaacactatgaggtaccattaaaaatgttatataaaccaggagcagcggctcacacctgtaataccagcactttgggaagctaaggcaggaggatcacttgggcccaggagtttgagactgcagtgacttatgatggcaccactgcactctagcctgggcaacacagtgataccccatctctttaaaagaaaaaaaagaagaagaaacaagaatatgctgctttaagtttgtactatttttataaattaattttaattttaaaaaacactttaactgctatataaaaataatactataactaaaaatattgtaatctgaatctttaaggaaaaccatacaaatttactaaatgaggttatcattaccaaatatcttcttggcacttttaagttttaaattgagtgttttcttagctggttgaaggctgaaattcattatcttcttatagaactcttgttatatagaaaacacttaattatgaagtagttattcatacacatgaaagataaactggtcctgaatttcctcctcaataatataaatgttatcctaagaaacaggaaaaaaatggtggcttgggtaattaaaattcagagataaacacaatcttcagtacccaaattcaattgaattcaaagtcttcaaccacctattattttattttattttattttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggcctcacctattattttataaagctgctgacaaatattaaagttttaatagttgttttctctaatttgattgcccttatagattttcctgaatgatgtgctaagtagcataattgtgaataagcagaaagtaagagagaatataaaaagctaacacacatatacacttcaaaaacaaacttgatgagaacttagtcacaaagggtataaaccctctcaggatcgtaactccaggtgacttttctttttcactcttactaattttaccaactacgaaagggaatcagataatcctagaataggtaagagaggaaaagcaggcttggaagtgatcaacagactctatataaggccactaaaggaactagggagtgataagtaaactagttagtagaagtattaataaaaatttcaggccccagaatcatgctcacagattggaaaggttagatttttctgttgctttaatattatacaattgcaggaaatattataagcttcatttgtccaacagcatcatgagaacaggtaatgaatacaatatttcaggttcagctcacagaactaattttcataaattcttatataagtgaaaaacctcttatcctattgcaatgttctcaatctcattgccattaagactcttcacacaataaccactcagttaagagaatgacagagggattttttttcatgtgttttttggctgcataaatgtcttcttttgagaagtgtctgttcatatccttcgcccacttgttgatggggtggtttgttttgttcttgtaaatttgtttgagttcattgtagattctggatattagccctttgtcagatgagtaggttgcaaaaattttctcccattctgtaggttgcctgttcactctgatggtagtttcttttgctgtgcagaagctttttagtttaattaggtcccatttgtcaattttggcttttgttgccattgcttttggtgttttagacatgaagtccttgcccatgcctatgttctgaatggtattgcctaggttttcttctagggtttttatggttttaggtctaacatttaagtctttaatccatcttgaattaatttttgtataaggtgtaaggaagggatccagtttcagccttctacatgtggctagccagttttcccaacaccatttattaaaaagggaatcctttccccattgcttgtttttctcaggtttgtcaaagatcagatagttgcagatatgcggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcaggctcttttttggttccacatgaactttaaagtagttttttccaattctgtgaagaaagtcattggtagcttgatggggatggcattgaatctataaattacctggggccgtatggccattttcacaatattgattcttcctacccatgagcatggaatgttcttccatttgtttgtatcctcttttatttcgttgagcagtggtttgtagttctccttgaagaagtccttcacatcccttgtaagttggattcctaggtattttattctctttgaagcaattgtgaatgggagttcactcatgatttggctctctgtttgtctgttattggtgtataagaatgcttgtgatttttgtacattgattttgtatactgagactttgctgaagttgcttatcagcttgaggagattttgggctgagacaatggggttttctagatatacaatcatgtcatctgcaaacagggacaatttgacttcttcttttcctaatcgaatatcctctatttccttctcctgcctgattgccctggccagaacttccaacactatgttgaacaggagtggtgagagagggcatccctgtcttgtgcccgttttcaaagggaatgcttcatcatcactggccatcagagaaatgcaaatcaaaaccacaatgagataccatctcacaccagttagaatggcgatcattaaaaagtcaggaaacaacaggtgccggaaaggatgtggagaaataggaatacttttacactgttggtgggactgtaaactagttcaaccattgtggaagtcagtgtggtgattcctcagggatctagaactagaagtaccatttgacccagccatcccattactgggtatatacccaaaggattacaaatcatgctgctataaagacacatgcgaaggtatgtttatagcggcactattcacaatagcaaagacttggaaccaacccaaatgtccaacaatgatagactggattaagaaaatgtggcacacatacaccatggaatactatgcagccataaaaatgatgagttcatgtcctttgtagggacatggatgaaactggaaaccatcattctcagcaaactatcacaaggacaaaaaaccgaacactgcatgttctcactcataggtggaattgaacaatgagaacacacggacacaggaaggggaacatcacacaccagggactgttgtggggtcgggggagaggggagggatagcattaggagatatacctaatgctaaatgatgagttaatggttgcagcacaccaacgtggcacatgtatacatatgtaacaaacctgcacgttgtgcacatgtaccctaaaacttaaagtataataataataaaatttaaaaaaaaagagaatgacagagggattaccaaaacagaaagggtacacatgctgatagtaatatccaattcacaaatattcctctacgcagttctaacccaggaaatatgtcttgtaattatgaaactttgatattttctgctatatagaagcattcattctaaacagtgaaatattctaaaaagttttgagtctatattaaggagaacattttaattaatgtgtctatcaaaataaaattagagttaatataagcaacatcaatgaaaggtttgtggaaaagaatgttttatttttatgggtacatagtgtatgtatttatggggtacatgagaaattttgatacagaaatacagtgtgtaataatcacatcagggtaaacagggtatccatcacctcaagcatttatttctttgtgttacaaacattccaattatactctagttattttaaaatatataataaattaatgttgactgtagtcaccctgttgtgctatcaaatgctaggtcttattcattccctctaattatatttttgtacccattaaccatccccactgccctactccccttcccagcctctggtaaccatcatcctactctcttatattcatgagttcaattgttttcatttttagcttcagcaaatgagtgagaacatgcaaagtttctctttctgtgcctggcttatttcacttgacataacgtcttccaattccatccatgttgttgcaaattacaggatctcattatttacaattgaataatactacattgtgtatacgtgacacattttcttcatctatttgtctgttgatggacacttaggttgattccaaattttggctattgggaatagtgctgcaataaacatgggggtgtaaatatgtctttgatatattgatttcttttcttttgggcatatacttagcaatgggattgctggatcatatggtatttctctatatttctagttgtttgaggaacctccatactgttctccatagtggctctactaatttacattcccaccaacagcatacaaatgttcccttttctccacatcttctacagcattcattattgcctgtcttttggaggtaagccattgtaactggggtgaaatgatatctccttgtagttttgatttgcatttctctgatgatcagtgatgttgaacatcttttcatatgcctgtctgccatttgtatgtcttcttttgataaatgtcttttcaaatattttgccaatattttaattgaattactagatttttttcccatagagttgtttgagctccttatatattctggttattaatcccttgtcagatggatagtttgcaaatattttctctcattctgtggattgtctcttcattgtttcctttactgtgcagaagctttttaacttgatgtgatcccatttgtccatgtttgctttggttgcctgtgcttgtgaggtattactcaagaaatctttgcccagtccaatgtcctgaagagtttctacaaaattttcttgtaccaatttcatagtctggggtcttaaagtctttaatccattctgatttgatttttttagatggcaagagataggggtccagtttcattcttgtgcatatggatatcaagttttcccagcaccatttactgaagagactgtctttttccccaatgtacgttctggcacctttgtcaaaaatgagttcactgtaggtgtgtggatttgtttctgggttctctattctgttccattggtctgtgtctgtttttatgccagtactgtgctgtgttggtcactatagctctgtagtataatttgaattcagataatgtgattcctccggttttgttcattttgcttgggatggctttgtctattttgggtcctttgtggttccatataaattttaggattattttttatgtttctgtgaagaatatcactggtattttgatagggattacattgaatctgtagactgctttgggtagtatggacattttgacaatagtgattcttccaatccatgaacatgaaatatttttccatttttccatgtcctcttcaatttcttgcatcagtgttgtatagttttcactgtagaaatctttcacatctttggttaagtttattcctgggtatttttttatgagattactttcttgatttctttttaagactgttcaccctggcatatagaacactactgattttttatgttggttttgtattctgcaactttactgaatgtgtttatcagttctaatagttttttggtgggggcttcaggtttttctaaatataagactatatcatctgcaaacaaggataatttgacttcttcctttccattttggatgctctttctttctttctcttgtctgattgcttagctgggacttgcagtaccatgttgaataacagtagtgaaaggaagcatctttgtcttgttctagattttatgggaaaggttttccatttttccccattcagtaagatactagctgtgggtctgttgtatattgcttttactgtgttcaagtatgttccttctattccaagtgttttgagggttttatcatgaagggatgttgaattttatcaaatgttttttcagtatcaaatgaaatgatcatatagtttttctcagtatctaatgaaatgatcatatagtttttgtccttcattctgttgatatgatgtatcacagtgattgatctgtgcatgttgaaccatccttacctccctgggataaatcccacttggtcatgataaatgatctttttgatgtgttgttagatttggcttgctagtgttttgttgaggatttctgcatcaatgttcatcagtaatactggcctgtagttttctttttttgatgtatctttgtctggttttggtatcaaggtaatactgaccttgcagaatgaacctggaaggagaaactacttccatttttcagaatagtttgagtagagctggtattaatttttctttaaatgtttggtaaaatttagcagtgaagtcattggatcctcggcttctctttgctgggagactttttattacagctcagtcttgtcagttgttattggtctgttcaagttttggatttcttcatggttaaatcttggtagggtatgtgattaggaatttatccatttcttctaactattccaatttttttggtatatagctgctcacactagtctctaatgatcttttgaatttctgcagtatacatcataatgtctgttttttcatctctgattttactggatcttctctttttcttagtctggctaaaggtttcccaattttgtttatctttcgaaaaccaacttggtgaaaaagattaaattcagtaggtcttaaatactttggtactttaggagattaatacaaaaaagaaaaaaagacatggattcttcaaacatctcacaatgaagagaggataaacacattaattttgtatataaaggagggaggagatatgtacataaatgcttgtctaagtatagaatctctacagaaggatatgtgaaaaccaaaaagaatgattgcctttgggtcagaggactgggggactggtgatctgggataagagcacttaattttcattatatactatttcccactgttggaatatttgaatgtatatacagtcctttctattccgataaataaattaaaaagcataaaccatatataaaataacttttacaaaacaaagttaaacgtaagagatataaattacacttgatattcaaaggatagaaagatcctattcacctacagaagcagagtaagtaccaataagggggtggtccatgagatggatgggtagaatagatatataacaaaaatcattccagggaagagaacacctgactatagccacaaagttgggaagggatggggcgtgtttagaaaagtgatagtttagaagcttaggctgcatataaggatgtgttctttttctgtagatgcctgacaaaaaaaaaaaaaaactatacagttagcatcttaaagaacgcacatttaccatctcacaggttttgtggtcaggagtctgaattagctaggtcctctacacagggtctcacaggctgaaatcaaaatgtccaccaagactatggtttcctcttaagcatagggccctcttttaacatcactggttgctgacataattcatttccctgcagttttaagacagacactcacccattttcttgctgtcagtcaggagccactctcaacttctagatgccaccagcgattccctgcctagtagtccctcaataagccctctaatgctcccaagatttgaatctttctaacttcagagaaaacccaatcccttttaaaggctcacttgattagatcaggcccacccagataatggccctcttaactgacttaaagtcaactgattagtgacctcatcacaagtgactctacaggatgtgtaccctataggatgacgtattagtccattctcacattgctataaggaaatacctgacactggataatttataaagaaaagaagtttaattgactcacagttccgcatggctgaggcctcaggaaacttacaatcatggcagaaggcacctcctcacagggcagcaggagaaagaatgagtgcaagcaggggaaatgccagatgtttataaaatgatcagattttgcgagactcactatcacaagaacagcatgggggaaaccaaccccatgatctgattacctccacctggtcctgccctggatgtatggggattatgaggattacaatccaaggtgagatttgggtggggacatggagccaaaccatatcaggtgagaatcttgggagccatcctagaattctgccaagcatagctggtaacagaagatgagaacaaaaattctcaaaagctaagccaaaattaaatagttttccatcctatatttctgtctccaaacgttatgctacttgtaaaatacacagggataattaggccaggcacagtggctcacacctgtaatcccagcactttgggaggtcaagatgggaggatcacttgaggccaggagttcaggaccagcctggccaatatggcaagaccccatctcttaaaaaaatggataattacagttgcaactgagaaacctcccatatttggtaactgtctactctttggctatttgtggtactcatttattataaggcctatgttactgactgggaatatctacttctcccttcgcagtcttttattcaatataaaccattcctacctctgtttgctgtactcttggctgccttgtctgttactgttagattaatatttaacttactaaggtcctcctcactccacaaagacctagcctctttattacttttttcccgctattttcagccattacttttgtgaccttgcataaattcacactagaaaagtgtaagtattcaatggttatatagcttccaactttgtttttgcagttttataaccttatttgatgtattcaatgatcagtagtttgttctcatctacactgaatgactatagattttttaaagtggaaacaggtacataggtaaccaaagtatacagcttgcttgggaaccttcatcctcattatgtttctggacaaccacatatggatacagtatgggacatcccttaaccttaggcctagtcagctttgttgaacctgttatcaatacgcacatctggagttcccatctccttcatgatggcaaatttctggatctctctgagtgccccaggggcatgcttcttgaagcccactcatggatgtgcttctgagtgttgatggtgtattcttgtgtcaccacctcattgacagcaggagagcccttcttcttcccacccttctctgcaggggccattctgccaggccaaagttggaaagtaacctccatcttaactacccaagaaagaagaaaaacaaacagcatagctttggtgtaagcaaaatgtcaattctacagctacatggtcaataagtatacacataattaatatttctacaatgttgaatatgattatttaggaaaacaagtctcagagttagaaatacccacttctcctttgatctggcagcttatattcttctcacagacaaaaatcaaaagcccttgataattttgcctgctgattgggaggcaatgctgatagacaaagaagtagaacactatgaaaagaaggcctcctgatacagttgctagtctttcctgacaacgtggcatatggttccaaatcttcaaacagctatcatattgctacactgatttaacaaggtgatctgtattctcccaaattaaatacatgtagagcactaggataccttcttctgagaaaaggggtatttattttctttctttgatactagatttatagcataacagttaagcctgcaagtaccaactgagtttctactaagtgtaacacattgtctagtaggtgggtgatggtagcaaagagaagatacatgataaatcagtcatgaatcctgccctcaagttatatataataagtgaaaagaaaatcctgggagcagaatcgacccaattttcctttctcttctgatgtcaggtgggctctgaacacaatcctcataatccccatttcctagtttccatgcaccattgtgatccctccccttgagtatgggcaggacctgtggcttgtttctagtcaaaagaataagcaaaggtgacacgacagatgggatacatgtacatgactatgtgattatgttacacaaacttgtcatacccattttgttggagtctctgtcttttaccggctttaaggaagcaagtggccatatggccaggaactgcaggacgattctagttgctgaagctggctctggactgatagccagcaagaaattgaaaccctcagtcctacaaccacaggaattaaattctgccaacagctgaaatgagcttgaaaacatctccttccctaattgagccccagttgagaactaagtactggcaaatatgttgattgaagctttgtgagaccttgagcagaggattcaagtcagctgtgccctgactcctggccccaaaaactatgagacaacaagtacacattgctttaagccactaagtttatgataatattgttatacaacaatagatgactaacacatctttcttcttatattattcaagttgctaacatatcataagaggtaaactcaagtattctgaacatccagtcaccactggtgacatgaaatccccagcccacatgctagagaaaaccagagttggtcacacagccagacccttttgtaagattcaagcggcaatttgccaccaatattgccaaaatagccagtatggctgcccaattaacagatcaaaaactaaagatcagctgctaattcctgccttgtacattctcagagagtaaggaccttccatttcccgactaaatgctcagaatgagccatcaggcctgttaggtaaaaatgagaaatttgaaggatcaagcggccccgcagacgctggtagagagggcaagcttaaggtgtagaagaaaactgtcattcccacttaatccaaaaaagtaaaaatatatgcctcctattttctttcagatataataaccaccttttcttaaacaatagcttatttgggggcctgcattcattacaaacaaaccagagtaggcttatatatcatctgaaggttcttttttaaaaaatttcttttgagacagggtcttgctctgtcacctagactggagtgcagtggcacaatcataactcactgcagcctcgacctactgggctcaaggaattcttctgcctcagcccctgagtatctaggactacaggtgactgtgaccacagccaggtacttttctattttttgtagagatgggatctcactgtgtttcccaggctggtctcaaactcctgggctcaagcaatcctcccacctcagcctcccaaagtgctgggattacaggtgtgagccaccatgcccagctaatttttattttttcttttttgtagagacaggggtctcactatgttgaccagaatagtcttgaactcctggaggatagtaatcctcctgccccagccttcgaaagtgctgggattacaagtgtgagccactgtgcccggccacatgaaggttctttccattgttcttccagaagtctcatcatcacaggctcattgtagtataaatattttcacataaggaatgaaagtgatgtgttagcatgatcttatcaggatcaaggtaactaaaaacaaatgacaaggtttctctttttattattcaacattgagaagcagaaaagtgttcaactgttactgtatttatttaatgctcaccttttaaagagtaaattcagttagttacgtgttataaaatgtgagataagacataatcctagagtaatgaaattttctcctttgtaaaaggagattcactataatttttcatgtaaagggaacatgaaaccaataacctagttccaaatggacagctaataaaattaagtttgcacatttaagagaaagttattttaatttcctttaattgtatacaatgttaaaaaggctttttgcaaatcattaacagttaagacgtactttcattgacaatttaggtagacaaaatattcaatgttgtgtgacaaaatcattcttataacattagtaaatgcataagcacatttccaaaaattgcaagaaataaaagccaaataattggaaagaatacacatttactctaagtaaagcttgattatacgcccagagatgagcatgcaaagtatagcctaatctatactcccacaatgcctcaaggtatctctgagtgccctgtttgtgaacatctgggtcagttctatggctgacaccacaatgtcctaaatagggcatgacaataaatgaaatgtacaataatgtaaagcagtataacctctagatacaataaggcactaaatgtaacaacgttaaaaatcagcaatatagaagctaataataaaacaaaacaaaaacatttatgggggtttcagggggaaaaaaactaggcagagtaaatgaaagataatctgtaggttacctctattcgctcctatcaggggcaagattcacatcctggtctctcccctgctaatacctgatgaatcaaactgatgaacatacagccaatcaacgaagccaaaaaaaatgatacttaaaataaatacctgaaaagatggatcccacattacatcttacttaacgcttccaacttgctatgagaaagatactaagatacgcaaagttgaaagtgattcaaattccacactaacaatttaaatgccttgtaagagaaagaatattcacacataataatacaaagcaaagcatgagatgagtcatgagaagatacaagtaaagtgggaccagagcttagagggtgaaagacgacttctagctaagataaggaagggcatcacagaggaaggggcatttaagttagattttaaaagatagaatttgaaaatacagactatagtagccttcatttcaatcaaaagcagcagcatatgccttcataactgcaatgaaatattatgtacgtaattattgaatgtctctcttcctcaatagatgtcaagttctgagagggctgagactatactttttcaatggtctccttagtacctagcagaatatctggtatgtcacagatgttcaacaaatatttattaaaggaataaataaacagaggcaggaatatagaggacaaatcgctcaatttgcctagtaaatatagaagacagggacatgaagaacaaaagatcacttaaggtgaaatgacagaagaccttgaaaagtcaaactgaagaatgtttatttggttggaaataaggagtcactgaagatctttatggaatgtagtgacataactagatctgtgctttcaaaagtatatctaaaagtaatgtacatggcagactacaaaaaagataaaatgaagaagtcaagagatcattataggagtctagatcaaagataacaaggacctgaagtagaataaaggcagtgggaatagaaagttaaaaaaaaaaataacgacagggatattaaacagataaaatcaatagaacaatcagttagttatccattccacaaacatcttttgagcaactactacatatctaccagacactgccaggagctggagacaggaaaaataaaataagctgtagtccttcacctcagagttgagagtcaatctgtcatctcaataagaaaaactgattgaaaactgatctcctagctaagataaggaaaggcatcatagaggaaggagcatttaagttgaattttaaaagacagtttgaaaatgtagaatatggtagactttatttcagccctttcagaataacacaataaatgaagaaagggagaagtcaatgcctctcttaaattttgagaacagaaactaagaggatggcatcaccatgcagagaatggaagaacaaaacagaagaaggtggacagggaggacggtatggacagattctgacacactgtctttgtgtggaatacgcaagtgaaaatgttcctgaattagttgcaaattcagaactggaggacagagcacagattagggcttatgatttgaaaggcatctagcataaatatgagagctgaaattgagagcagacaaggtaagaaagggtgaaacatgtagaaccttggagatgatccatatttaacgagatgagagaaggcaaagggaagaattaagagaaaattatcagaaaatcaaaccaagccaaaccaggaaagaggagagcaatcagaggcaaaaggatcatcaggacaacaataagtgtttccagaagcatggaccatcaacagcattatttgcaacagagaaatcacggaaaattaggactgacaaaaaggccactggatttgggaataaaagaaatgtattagtgatatttgagagagcagcagagtgataagggaaaactcagtttgcaaggagttaaggtatcagtgaatggtgaggcagtggagatagctggaacaaactgctctcttgaagtctgaaaatgaaggaaaagaaaatgatggaacaatagcttgagggacaacagaaggaagaaaaaaatttaggctaaggaaagattatatgagtatgtcttttgttggagaaaaagtggacaaaaaaagcaacattttttttagaacaggaaagagcagagatagaagatccagtaaaggcataaatcaaagatgcataaaatacttgatgtattcattcaataagtatttattgaatgcccaccataaactcaaaactggagaatatacaccggagaacaagctaggtaggatcccaagctcatggagcttgtatgtctaagcttccagaggaaaaggaagaatacagtggacagggtagaatgcctttattctaccctgttgttgcagaacagccacagagtttggatggaattaattccactgctaccaatggtctcagaaatcagcatcatcttatctgtgttatcagggtatttgattcacgaatgaccacacaacctaagttggtcctatcagaatgaaacctgggactttgattaaatggaaaagaggacaatcctgatcgacaaaatgtgctgaggtgaggtcgggaactgttgcatacattttgctacctgaaagaagcccacttgtgctgaaggcaacatagaggaggattgagctgagagaattatggctgtaaaaaatgaaactctgatcaaaccacatctgaaacccatcctttctttggacttttcagttacatgatccaaaacatctctttctttgtttaaggccatttaagccgagctttttgataatttcaagtaaaaccatcctaattacaaattagatgtcactgtaggcacaagtaaaacggttataaaactgcagcacaaaataagacctgcccagtgcagataccagagactgtgccctttctccactcttctggctttagctgtctgtattagtcagttctcacgctgctaataaagatatacacaacactgggtaatttataaaggaaagaggtttaactgactctcagttccacatggctggggaggactcacaatcatggcagaaggcaaaggaggagcaaagtcatgtcctgcatggcagcaggcaagagaaaacttgtgtaagagaactcccctttataaaaccagatctcgtgagacttactcactatcatgagaacagtatgggaaagacccacccccatgattcaattaccccccaccaggtccctgccacaacatgcggggattatggaagctacagttcaagatttgggtggggacacagctgaaacatatcactgttcatggttctaagctttgaaactacaactcattctcttttttttaaattatactttaagttctgggatacatgtgcagaacatgcaggttacataggtatacatatgccatggtggtttgctgcacccatcaacccatcatctacattaggtatttctcctaatgctatccctcccctagcccccaccccgcgacaggccccagtgtgtgatgttcccctccctgtgcccatatgttctcattgttcaactcctgctccttctcctataaatcctttccccactcctccacccaaggttattttctcttcatcagcccctaaacttcaagagatcttagcagcctgggagcataagggcactcttcctctcagcagcatccaaatttaccccatcttcatgctccagaattaagtgagaggggcctatgacttgagcaacagtcaccaataagggaattcttgggcctaggcccagcgaatatcctttctgcaagtttgcccctgtggctgtatcaaccctgagtttccatcttttcgtatcaatctggctgacttctcttcctttgaaactagactcacagtgcatctcctcctggaaggcctccttcccagtggcccttggccgtcagatgctgctcctcagggttcccatgaaaatcaatactcacctcctcctagccacacagacatggaaggacagagctagatacaatgtgatgttgttcttactgggacaaggattacactttattttatttgtgtataacctacatgtgtgggggaaatgaatgtcacttgtaatgtggaggaatgggtgctggactcgcaggcaaaacacaagacttccaggcatgaggggatttcttacaagttgcaggacctctccaagattcttaatctataaggactttatcactgggttgttgtgagattaagaagcatactgaatctgaaaagtattgtagtcctttgagaatgatacctagaaatatttttgttggatattatgaatgttcagaggaggcaagagatgccttcttgctagggattgctagggaaaaactggagacatagataagtgaaaaactcaagaagaagctggcctttaagctgactttggagaatgtgtaagatttagacatgctgaaatggggatggggagaggtagccaggtgaaggaagccaaaagctgagaagccagcatcaacttagcagctaattttactaagcaaatatgtgccaaccactcttctaagtgccagggttacaacagtgaaaaattcagaggaggcccctaccctaagagggtttacattccagttgggaaagacagacaataaacaaagacaaagatatgaaatgatttctgttagaggtaagtgatgtgaaggtgatgtgctatggggactggaggggaaacattccaggtaaggtagtaaaggccattctgaggtgatgacatttaacctgggaagaaagtgataaaatagagtggagctgaggaagaatatgccaaaggaaataccaggtgcaaaggccctgaagtaggaacaagcttggcgtgtttgtaaaaccagaaaaaaaaaaaaaaagccaatgtggctacagcaaagtggacaaaaacaaaagtagtatgagattaaggctgaggttatatctaagtaacagcacggtgtcagtttagattgaagtttgtagtagtagatgatccttgaaaacaaatttgggctagaattagaaaatctcagacaccaaattaaggtggatatatttcattcttcaaaagcaattgtctcacaatataatgagccaggtctgcgaggcaagtcctcagggatgcccacagatatttctcataaattaggtgactcttgtggaggtcatgggcacttaatccagaacaccaaggcagcaaggcaaagcagctgcgagactgttggtgacgtggaacacagactgagcagaaagttctctagctcaatttcccctgttgcaggaagaaatgaagcccagagaagaaaacaggcctgggaggagagagagtagacatcataactgatgttcaccaatacgtggttctcctctagttctgcccaaacaagaatgataatgtgtcactttgggaccaaagcatttaattgctggtgtttggctccccgaacctgccatggcaatcacttgttaccatggaggtgttatagacaggtacagtgtagaatgcagagccaatatctggagggaggctgccatggagaatcccccagatccactctggtggtgttaactcactgagaaattggaggttgtttgttatggaaggataacctaacctgtaatgattaatacaggatatagacagagtttttaaaaagaccagaaagagtagacattcttgctctgagtggggaaaggaggaggagagaatatgagatactactcaatgtctctgacagcatgcattttttgccccaattctccattcttggctagatcagtgacctttatcagatatgtaagccttgcacaaaataccatagactgggtggattattaaacagaaatttattttctcacatttctggaggctgcaaatctgagatcagggtgccagcatggtagagttctggtgtgcagatggccaccttctcgctgtgtcctcacatgacaaagagagaaagagagcaagctctctggtgtctcttcctataaaagctctaagcccatcatgagggccctaccctcatgacctcatctaaacctaattatatctcaaaggccccatccccaaataccatcacattgggggtcagggcttcaatatatgaaattttgggcaatggatatgattccatctatatctgagtgttttctcccactctttggtttacactttggccatgtgatttgcttggctaacagaatgagctggaattgacagtatatgccagttccaaagccaagccttaaagagcccttacatgttaacagtttcccccttgcacctctgctatgggcatgagaagaacatggcatggctagaccattccacaaaggaggacagaaatacatggagtactaccaccactgcaaacacatattgcaacaatctgcaacatgcagaaccacgacccaccaagcctgcagcataaatgacaaatgattatgtttttaagacagcaagtttgtggtggtttgttaggaagcactactggggcagtaggtaattgatctatataatgactacaggaaaatggccaaggaggacctgtggctctttaggaagagtcttatgctaacaaagctgcctaggaaaattaagttgtactgctccaaagactcttctcttcaaatcctgttttcttatttaccttttccagttccctgaaataggtcctaaattcaactctgatactggtcagcaaggtttgtgaagaagacaaaagcactggggagggggatacagaatcataaagtaatacaaaaaaaaaaaaaacagaaaagaaaatttcaggggagaaaaatcaagtgcaatacaaaacaccaaaggaaatgagatctgaggtctctaagtttactaagaaggctagtcatcatgaagccatttttggacaccagggagacagaggcatgggagttcaggaaaaaacaagtggcaagaaaattgagacagtgagtttaaatcattgagtttagaaacgtaacaatgaaaagaataaaaaatagagcaacaactagtggagcaggaaatagaattcatttcctaatacagaagacctatatatataggtttctatatcagtgctatatcagtgctatatcagttttctgttgccacaaaacaaattattacaaacttattatctcacggttttgtaggtcagaagtctgagtgagcttagctggggtctctgcttcaagtctcacaaagccagcatcaaggtgtcaaccaaactgggctcttatctggaagttctagagaataagacctccgggcatattcaggtggttggcagaattcagttccacacagcaaataggactgaagtccccatttccttgctggctattggctggaggttgctcacaactcctagatgctgttctctggccctgcatgtgctcatctccatcttcaaagtcagcaatggtgcactggacctttatcatattttgaatgtccctgacttcttcttctaatagcagctagaaacaaatctgttcaaaggcccatgtgactgtattagacccagataacctccctaccttaaggtcaactgattaggaacctcaattatatctcaaaaccccttgtgctgtgtaacctaacataattatggaagtaacagccatcatatttacagtcctagaaattatggcagaaatcttagagggccatcttaggattctgcctaccacatgtacacatttaaagttgaaaaagatccaaaagcgaaaagaccttgaagaagattttaaatagaaccttgtattacacaaattacctataaataggaaggaaagaaatcaaggaaaaagtatgccatcctggccatagcaaaaaaaaagaaggatgccttttattggagatttgaagaaagaattaaaaaaaaaaagaaaaaaaaaggcagaggcaaaagacaccttttatgccaactatttactttgccaaaattagtatcattttaatttagatacaaagaaacatattctaggctctttgaaaaagttcctccagatggttacatctccctggagtgacagcacctagcgtagccttgcacatattgggaattcaattaaacactgctgaccatctgattgagaattcagaggctggagtagctgactcaatataaacatatggcttagttcccatcaaaggaaaaatcaagtcactctattctcctccccaacatcgcacctcctttgcaatgtaggagaaaacagatatgaactaataaaaatagacgatgtaacagagattaggaaacaggcaaactggagaatacaaaatttctctaattttaccataaaatcagaatgcttcagctaaggatcagcactgtaaatatgtcattcttaattcaattgcattcaatcagatcaatactttccgatcatggcttcaggatatttaagatggggaagacacaatctgagcccagctgctaagtgttgggggataggagaagcacacaaatgactatactgtgaggttgagctatattaattgtggaaagccaaatgaagataagaaaacaaattaaaccacttttaaccctcttaagagccatatgaaatatttatacatgagaaaaagcctcaggcagatcaaaaatatttttcaagatcatataccaagtatattgtagggtacagattcaaattcaagactgactccaaactcagtctctcccaaagaagaggcaaatcacctctggttggctagttggatgggagtttggaggctggtggagagaaaccaggaacagtttcttagggaagcagttatttcaggtaaaacttggaaagatatacacagttttgaaaagctgagatggcaaagaaggagaacatttccaggaggaacagcaaaaagcacagaagcaagaaatcaggatcaacatttggagaatggtgagtagatcaagtagcacaaactctttacaaataaagatagattggatgcacattctggaagtcaaatattggggttaataagttactgtaatagttcagggaagagcctaaactagaatctcagacatgaaaaaggagaaaaggagaagaggggactaatgtgaggagtcagatggaagattactctcttatgtttacattacagtcaacaacaacaacaaaaaagacagccaagtccaaaaactaagcttggattcaaaagaaaaaagtcatccctctgccaccctcttttgccctctagtctagaggttagtaaactatggcccacagggcaaattcaacccaccatctgtctctgtaaataaaattctactggaacacagccgtgtccactcatttacggattgttaatggctgctttcaccctataatagcaaagactatgtggtccacaagacctaaaatatttactttctagtgctttacagaaaaaaaaaaattgtcaacgcttgctctagttccatactccacaagccactcttatttgtttgtttgtttgtttgtgacagggtctcactctgtaacccagactggagtgcagtagcacgatcacagctcactgcaggctaaagcaattctctcacctcagcctcccaaatagctgggattacaggtgcacgccatcatgctcagttaatttttttttttttttttttttttttttagcagagacgagctctgtctgtgttgcccaggcttgtctcaaactcctgggctcaaacaatcacctgcctaggcctcccaaagtgctgagattacaggcgtaagccacttcacctggcctgttccaattcttttagtagcttgttctcatctaaatattaagcttatttggatatttcctgactgataaattatcaagactatcatttgaattcctattatagtaactgagactttggcttgcttgcaccatcagccttccccgcatcctccccactctccttccccaccacacatactttcctttccccgtatgaatatatatttatattcgtagtgtttgcaacattattgtgactacataaatattcttcattactgagccagataatgtaatgtaattatgtttatgtttccatgcttataaaaatgttattttctgaagttaatagttatcatttgtttcatttgcttagtttttcatttacctatcactattttttctgagtccaacacatttgttctgttcatttttttccaaacattcaaacacaccaaatacttcatttttatttgttcccctcaaaaccaccccccccaataaccctccatcctttttctctaatctgagtggttgctctcaaggcctagtgaacagttgcttttctggaacttctctctgccctgccatattgagtctgttctcctgaatcctatgtctttctctttattgattttctcccttgttttatggaagctcatcctccagaagctttctatgaaatcacacataagatataaattgtttaatccttccaggacttagaatttcttcattctgtcctcatatctaattgatactttcagccggatagagaaatctaaactgaaaaggatttccccctcagaattttgaaagcattgcaccactgtcctctaccagccagtgttgccataagagtttgatgccattctgatttccatccatctctatgtgacttgtgttaatgctttgtttcattttatactcccttcacaaagcttttaggaccttattttaatctatgatgttcttacatttcagaatgacatggctggtattcttttctcatttattgtgctagatacttgggcagccttttcagtctagagacttacatccaccggtactaggaaattttcttgtaatatttctttgatagcttccttcctttttcttgtcctctatttgtatcaggcaacctgtagctataataaggcttcataataaaccatcctaaaactcagagacataaaacaatagccattcataattgttctagaatctaccagtcagtcaggcagttctgctgatcttggttggatttggctagggagttctttttggtgttgactagacctcacacaggtatctggggtaggctggctgttagctgaatttaaatggtatttggagctagtgcagtggctcatacctataatctcagcactctgggaggctgaagcaggcagatcacctgaagccaggagctcgagatcagccttggcaacatagcaagaccttgcctctaccgaaaaaaaaaaaaaaattaaaattagccaggcacaatggcccatgcctgtagtcccaactataactcaggaggctgagccggaagatcacttgagcccagcagttggaggttacagtaagctgtgatcctgccactgcactctagccaaggagacagcgagactctttaattaattaatggtattaggtaggacagggacctgtttcatgagtctcatccacaagcatgttttcatgataatcacagaggtttcagacattgtatacacgtatcaaaatatcacactttagccaataatggatgcactttaaaaaaagaagaaaaaagtatcacccataaatatgtacaattatatgtcagttaaaataacagtagaagaaaaaatgtgctttttaagcctctgttgtgtcaagttttctataacaaaattgatcaaattgggtcacataaccaagtccagagtcagtatggagggcacctgcaaaaggcttggatacatgaattcatgcatggaacccctattggtcagatcttggaaatgctgaattgatcctctaattttcttttctttcctatgttccatctcttaggtttattttttttctttgttgctgctgctgttgttgatgatccactttctatgagatttcttcaatgttatcctgaaacttctaaaattttttatgttagttcataataaattttaaatttccaaactactttcttgttatctaattttacctgtttcatagcatccgttcttgttttaaaagtacaatatcttctcttattactctaatgaaattagtaagagtttttggaagtattcttcttgaattgcctctgcttccctcagcaggtgaagggaagtttcacccaacttcccacagcagagaaaggtatctgggtgatctaaaggctcttgtactttcaaccaagatccatgttctgctctgtgttttactcccagtttttgtggtgccgggagtttccaaatgtgagtctctaaagggtttgcatctcatcaatgtcttttctatagggacttcagaaaattaaaggtaactctctgcaggtagcattcttcctttatttttcatcttccaaaattttgttaagatctctcttctgctatcccaatttctttatccttataagttaataccttttaaagtcttctactgccatttcagtgagatttgaggaaggaaagaagaggagtttacatggtctatagacactctctccatttgcttttggacacagtgaattccaagtaacaccacaataataaagcagatatccaatgattgaaaacacaggtgaagctcaagataaaggtcagaattagagatgtaaattggagaactgcttatacagaaatggtttctacaactatcaaaggaaataaacaaaatataaaataaagacaaaatatccaatgatacaatatttagaaatgcctaagctaggaaaaagaaactatcaaagagctcaaagaaggaggaatgataaaaatagaagagtaagtgggttagtactaagtcacaaaggtcaagggagaaaaaggtttcaagagaaaaaaagacaatcaatgatatcaaatgctgctgagaaacacaggaagatgaggatgttgaggacataccatttggtgattaggaagatgatggtgaagtttaagagagttgtttcaatagcatatgagtacaaaagataaagaagtagatagtaaagtagataatgtattggtggttcttttttccccaataatctggtggccagtggaagacaaaaagcctgagataagtgagaggagaatttgaacatacatgaaagttaagaaaagtttttgtgtttttttggtttgttgtttaaggaaaaaaaaaaaaccttagcaagagtacaaaaggaaagatttgaggaaagaatgtaaatgcaaagatgaggaaaatcaaaggataataaaggactggaggagaaaggtaggatatgcactcatgagcacacatgcagaggttcatcttagaaaaggggaaggcattcttactgcaaggcagatatgcagggaaagagaaagaataaaagcagaggtagagagagacaccagaaaaaattctgaaaacctcatgcccaaatgtcctcaagctcagttaaataagaaaccaagttatctgctgagagcaagaatgaaatttatagagagtgaaaaaggtttggaacagctggtctggtaaatgtaatagggggtttgtgggggaggcggtatttattaatttacttaagaaatagcggcagcaagaaaagtctagataaagctattctaagttctgggagactctaaacaaaatatggatttagaaacagcaaaatttctgtttttcacaatagtagctataataatgagagatgctcagtgggtatgaggtaggtaatgtcaagtgatcagaataaaatatccaaaaattaacaaaacctgaatttttcaaaaggacttccttttgtattttactttttaagaagaaataagaaaaagaaaactaataaatcttcaatccagttctttcaacatttattccttgctaatttctgactaataaaagcgttaattccaggctaattaagccttcttaactgaccttcaaagttctcctcaactatgcctaactatatcaactccaatctcctttgtccaaacactactcctccactacaatctaaaatagttgcatttccatgcatagtagttcacatttgcaaatacaaaggctgctgaatcttagaatttatttatctctaccaatgaccaattgttcacaattaggttacttttggtcctgattccttttggaatttatatggaaagatgtaacatttacggagccattcattatcactgttgccttcaccctttccttagctaacagcagccacttgattcatttacctctaaagcattggttctcaaccagaagcaattttgcctcccagagaacacttagcaatgtctagagatgatttttggcatccagtgtgtacaggccagggatgctgcaatcctacaatgcaaaggaaaaccccaccccgtccccaacaaaaaaaaattatctggtccaaatgtcaatagtaccaaggttgggaaatcatgctcaaaagctacctcattcatattctaagacctataaataggtcaacaacgaaataaaacctgcctttggctcaagctcattctctcctctgctcctgatctcctacattcccaggccctttgtctgccttgaccattgagactttgattgcctttttcccagcaaggctatgatatcctgattctcagatccttagctcccttgggccatctgacacctaagatgcagttgcccctgtgaagttccaaaactccccaggcttgtttctcactggggggtctttaatccttgttttctggacttgagtctttgcacggtctggcctctaacataacctgactaatcctaatcatctatttctccctacaccccagggtgacaatatggtttgacagtgcacatcagagcagcctttaaaaggccttctcgagaccatcctggctgacacggtgaaaccccgtctctactaaaaatacaaaaattagccgggcatggtggcgcgcgcctgtagtcccagctactcgggaggctgaggcaggagaatggcgtgaacccgggaggcggagcttgcagtgagtcgagatcgcgccactgcgctccagcctgggcgacagagcgaaactccgtctcaaaaaaaaaaaaaaaaaaaaaaaaaaaaaaaaaaaaggccttctcctgtctaactttggagtctcagcattccatctcttcttcctgcagtcacctaaggggctgttacctatctccagaacaacagtttacatgtgttaagacctcattatatggttgctggaggaaaacatgaaccaataacttgcaggcttgagttacaaagaacatacatttaaaccaactgaattctggatctaacagttctttcattcagttaccaaaatatttattgaagtacagtaccaggcatgtgggggtgggtggcttaaaaaaagtatccataaatagctcacagcttagtatataaaatcagatatgtaaataagtaatctgtaattagactaattacagtcagattattcctattttataatatctaaagaaaattgtaaaagaaataaaatccttcctcagaattgacagaactaatggtcttaaaataaaagtacatgggatgaggctgggtgccatggctcatgcctgtagtctcagcactttgggaggccgaggcaggcagatggattccctgaggtcaggagttcaagaccagtctggacaacatggtgaaacctgtctctactaaaaatacaaaaattggccaggtgtggtggtgggcgcctataatcctagatactcaggaggctaaggcaggagaattacttgaacctgtgaggcagaggttgcagtgagctgagatcatgccattgcactccagcctgagtgacagagggagactctgtctcaaaaaaaaaaaaaaaaagcgcatggataaataaatgagcaaatgaacaagcagatggataaatgagaaaccaaatatcaaacaagtaaattttttctgggggtcttaggcaaagtggtacatcatgtaaatgagagcctcattattctactacatctcctttcttttcatcttccttaaatgtcattctcactataaatgctaattggtttagcatatataacaaattaatctgggtgatagaataatgctacaacacaatccatgctgaaaaatctttgcttctcagttttgcagataatgaagcctctaaacagacatagcccaccagtatgtagacagaccaggactgatactaggccaaaagacaccatgtagcctctccagatgtttacagccagtgtgcatctgactggtcagtgcttgtgcctcatcagtggtaagttgttttaatgtcacccttgatcagtacattctctcaattttagagcagcaggcagggctcccaagaagagatttcataactatattatgttcattctccctttaaaagtataaaaattccaattaccaattgacatagcagaaagcatccacctggttagactgacttttcctctgcataataccttgttaatccatcataatgatttattcatattgctgctgcactgagatatcagatgctacaactacgattatcactgttcctcgtaaagtggagtcttacagagctggctttgaacccaagctctatcaggtactgtctacgtgatgttcaacctcttctaggctgaagtacgtgagactttaaccaaatgcaattgaggaaaataatatttaccttagaggtttgttgtgagcattgataaggagacgatatatctatacagactagaacataccaggtgcttaatgaatcctagcttctccttttagccaaatctgatacaaacatattgatcaagttctttcccttccttcctttcaccatgtgatgcctgctccccttcaccttccaccacaactttttcttttctctttgcttaattttctttaagtccctccaccttatcggcaatttactttttcatttatcaaaagttactaagagcacgagcttaccactgcctctcccaaaatatctcctacaaatctctggaatccatagtgaaaagtagaaactatgattccaaatttgcctttaccctaaacacattgttttgcctttgttttaaagtggcttttccctcctcatctctgataattttccagcattaagagcattggcttttgagtcaagcaatcttggattccaaatccaattctgttgcttatgtagtcgaattacttacctggttgacttattaaatttctgtggctctcactgtcccaaaaactagaacatgtatggcaatgggcacaatgcctagcacataataggtgctcaaatatatcatatttaattgttctcagcactggcattgctaaccaagactaccttctcagtcaacaattagtctcaaagatacaatccaaatcatgtcccattagcatgtgccctgttctgtatttattcactcaactaatcatctcctgaatgctgtatatgttctaggcataaaataaagacatttgtacagcactttcaaagataactaaaccaaagtttcagacttaaaggaactcattgtctagtgggaaggcaaacatgtaaacaaataattacacggcagtatactaagtgctaaaaatagatgcatgtacaaggtgccagggaagcaccatagagagagatcaggcaaagcttccttgaagagatgactatgccagagttgagtctgggaggatgagcagggattcactgagcacacaagggaaagacggacattctgggagagacaggggcaggcaacagtggaaagtccatgatgcctgctgaaaacaccaagtacaggaattgagtcgggttggagagtgctgctacaaagaactggtgaaaaaatggggcagttaggagggagccaaaccacaaaaggcctcaagtgatgtgccaaagagtatggactttattcattaagcaatggcaagccactgattttttttgtttttggggggttttttgagacagggtctcactttgtcacccaggctggagtgcagtggcacgatctcagctcactacagcctcaacctcctgggctcaagtgatcctcccacctcagccccccaagtagctgggactacgggcatgcaccaccatgcctagctaatttttttgtattgttagcagagacggggtttcgccatgttggccaggctggtctctaactcctgagctcaaacaatccacccacctcagcctcccaaagtgctaggattacagatgtaagccactgtgcccagcctctattgatatatttctaagtcaaagaataacatgtttataatggcagaggaggaatcaggttggaaggactgttattggaagtggtgatactgagtggacagaagtagtaaggaaaaacgtcaggcatggctctagagtttctagtttaaatgatgcaccatagttcctaacacaaatgatgcaagtaacagagcagaactctgggtacagataattaatgttttgcatttcatacctccattgaggaggagatgttcaataggacaccggggataacatgtctagcgtgcaggagagagaaatgaattacagatacaggtttcgggtagattttggagaataataatttttaaaaccaaagaacatgctttttttttttttttttttgagacagagtctcactctgttgcccaggctagagtgcagtggcatggcgcgatcttggctcactgcaatctctgcctcccgggttcaagcgattctcatgcctcagcctcctgagtagcttggactacaggtgcaggccaccacacccagttaatttttttttttttttttttttttgtattttcagtagagacggagtttcaccgtgttagccaggatggtctcgatctcctgacctcatgatccacccgcctcagcctcccaaagtgatgggattacaggcgtgagccaccatgcctggccaagaacatgctttttaaaagaaatataattcatttagacttctctcccaacttcaagtgaaaagattacaaattaaaaaccttaaattactatctattgcatatatattaaaatctaacattaaaaaatatggaaagatgtcaacacatttaatgaaaacaaaaaactttaacagaggtaagtattgtatatttatttgtctattactttgcttaagcagtctgcttgctaatataaggacattttccttacctataagagtaacgtatttccaaaataatgttttcatggccaaaaaaaagcataacgcttgcttcatcttctgaataaacaagtgtgtttaatttcctgagtaaacattagtcatagttgacactgaacagcgtccaaattcaaggaaggagttaagaaatttctaaaaccccaagagcaatatacctcacccagagaatctagtgaagagcttattataaaggactaaaagtcaatgtcataccaaaattttaaataacatcatgcatccctctacttaataaattatttcaaaatcaggtcacaattgacagacacactatcttgggcagacgggagagactagataagcagggaaaatttccttttctctactgaagcatgtccaccaactgtcatatctggaaaacagccaaaatgagcactttatttgcaaaaagaacaggagatttataatgtgagcaaaatgtgtgctatataaatgcagaatatagagaattattttaagattcatatttctgtatgtttagaaataatgtttcaaagacgtagattaaaaccacaagttcatctatataaaaagctctaaaagccaagggtggcaacgcttaaatccctatagataagctttacccttttcttctgggctgtgaccatctatgcgaggtaaggtttccttataaacttctaagacagataatctggcctcacaggtatctaaatgaattagccacataaattactctgagaaaaccacagccaaatcatgtctctcttaaccttcctttccttctgctccctaaccctctgttttctctttagtcacagagcattttctagtttcctgaccacggggtttaccagccaaagctgacacagctgagttgagaagggaaagcagctgaactataaaggaaggaaatcagagagaaaagaggcagggagtctggaaatgctaactagaggggaaataagaaaaccctggactgtgtctgaatctgtagaaacttgcaactctagattaatgtcctcaactcaggtgttggcggcccttagtcaactaagggtttgcgaaaattttccaaatgggttcctcgctaatctaaaataaatacatattaaaaatagtaataatggcagagtctcaataacatttatagccaataaccagggaaaaggaagggtaggcattcattttgagtgactttactattggaaactcctggacagttacagcattgctattaacacaattgtcactttggataaggtgtccaactgcatcacacagtattttggttctttaaagaagttaggggctgggcatgatggctcacacctgtaatcccagcattttgagaggccgaggcggacggatcatctgaggtcaggaattcaagaccagcccggccaacatggtgaaactccatctctactaaaaataccaaaaattagccaggcgtggtgacaggcgcctgtagtctcagctactcaggaggctgaggcaggagaattgtttgaacccaggaggcagaggttgcagtgagcccagattgtgccactgcactccagcctgggcagcagagtgagactccctctcaaaaaaaacaaaacaaaacaaaacaagacaaaacaaacaacaaaacaaatgaagtgagagaatttaaacagaaaggaagtgggaaaggtaaggtgaagaaagacttctggtttgagtgtattctcttaaaaagttcacaaaatcgctgaggtaataaacatttttccacatgcctcttttctgagattttgtccaccttctcctccagccatgaggtggggctcaaggagactcagcagcccctagtttatgctacaagatcctatctccctgccttcccctcatcctcactgccttgattcctggtcttttcaaggcctggcagttcaacatttccttgattctatgaaagacttctatagtcataaattcccattcccctttaaagaaaaagcaagcaagacctccaaggaaggatatattaaacatggatcttgtacccttttctgcaactcctttcatcagtgagatgatgataatactatagattagattgtggagaaaataggtatctatccatcccaagagtcaagagttttggagggatttttaaaggtaatccaggaacaaataggataggtactctgcatgttcccttgttctgctgatgaatgtcacaaaatacaaagtttacgaagcatttctatggacacccaaggacaccataaaaacagaaagccaagatacaaatactttgaaatactgtgaaaaggtcctacgttattagaggtattgataagaaaacaagatgttaagaaaagagtagaaatcacgatctctttagatccctagatgttttcttgtgtattaagtatgacattttttaaatccaggctggtttagttgtttttttttaattttactttaagttccaggatatgtgtgcagaacgtgcaggtttgttacataggtatacatgtgccatggtggtttgctgcacctattgacccgtcctctaagttctcttccctaaccctcccacccccatcaggccctggtgtgtgttgttcccctccctgtgtccatgtgttctcattgctcaactcccacttataaatgagaacatgcagtttggttttctgttcccgtgttagtttgctgaggatgacggcttccagcttcatccatgtcctgcaaaggacatgatctcattcctttttattttatggctgtatagtattccatggtgcatatgtaccacattttctttatccagtctatcattgatgggcatttgggttggttccatgacttcgagattgtaaatagtgctgcaataaacatacgtgtgcatgtacctttatagaatgatttatattcctttgagtatatacccagtaatggtattgctgggtcaaatggtatttctggttctagatccttgaggaatcaccacactgtcttcaacaatgattgaactaatttatatgcccaccaacagtgtaaaagcttcctatttctccacagtctggccagcatctattgtctcttgactttttaataatcaccattctgactggcatgagatggtatttcattgtggttttgatttgcatttctctaatgatcagtgatgttgagctttttttttttttttttttttgagacggagtctcgctctgtcgcccaggctggagtgcagtggcatgatctcggctcactgccggctccgcctcccgggctcacgccattctcctgcctcagcctccggagtagctgggactacaggcgcccaccaccacacccggagaattttttgtatttttagtggagacggggtttcaccgtgttagccagaatggtctcgatctcctgacctcgtgatgcacccacctcggcctcccaaagtgctgggattacaggcgtgagccactgtgcccggccgatgttgagcttttttacccgtgtgttggccacgtaaatgtcttcttttgagaagcgtctgttcatatcctttgcccactttctgatggggttttttcttgtaaatttgtttaagttccttgtaaattctggctattagacctttgtcagatgggtagattgcaaaaattttctcccattctgtaggctgcctgttcactccgatgatagtttctttcattgtgcagaagctctttagtttaattagatcccatttgtcaagagttctcttcttaaggtagtaaaactaaaattcagatcatctttccattgagtttgttttcccaaacctagggaaggagagcaggaactggtaatagtgcctgctgtttattttttcttaaatgtggcatgcaaagctgaatgatcttttaaagtacagaatataactgcaatgaattatttctgcaatacttccaactatttttcccatttctttgcaattaatgatagcatttttttggctatagcaaatgtttactaaagagcttcctggacgtttctttgcttagatttatttctaggaattatagtttcctgatagtaacttaaagcttgggaaattcccagtatgaattacttactgtcctggttcatttgaagcaataatcatttttataagacctgtgcagatgtgccatattttataatatacttgtgtcaatttccagacatatttttatgacattttaaaaatcatagtgggaatatcatataacaagaaaaacctacttgctggaatccttatctctatcgaattctgcaaactcaacttcttcagtgaatgacagttaatatctcagttcttttataactctttttcggcattatcatcatcttactaaaattcttgagaatgcactttgctgataattatgataaagaaagaccttcagctaaacagcaaaaaaatatataaagattttctgtctctcattctggaggcctactacatgtccacaacactatacatgaaaaaaagcccattaaagaatgcaaagtgctgaccagcctatcaaattatcatcatctctcctccaaagtgcaaggagaaatagtatccaggagaattgccacacagtgctcatgctttggtcataatctgatgttacctaaaatcattaattgcccaattttcttccaatacaaggtacagccaatgctgactttgaaagagatattatcattgtcatcacctagataaaaagaagagcctcctccactttctcttccactccctattcctcttttccttccttctcatttcccttctcttcctgaaaaattcagttcctacactattaagtaacacagagaaaggtaggtgtccacatcagaggaaagatggaaggcacagtggaaaggtaggaggtgtgtccatattggggcaggcctagtgtggcgtaccatagcctaagtgagagggcatcccttctggcatgatatgagagggttagaacccacacagggtgaagagggtgcccatgtggtgatggcagaggggaacaccccagcatgggatgtcagtatccaaacagaatgagagggcatccacatgcaagggtgacctagtgcagggggattagagtccaagaaggatgaaaagattattcccctgtagatgcagaccaggagagagtcagatatgaaaagggtgaagaggtgtctctgcagaaggacagcctagtgtggggtgacagagcctaagagggaaaaggaggacattaacagaagggaggggacgatagtggagaggagattgatagcatataagacgacttatcaaataagtatatatacaaagataacagaagccagactggaggatgaaggaagttacaataaactcatatttttaataactatagagatgtaaatatgtgtacacagtgatgtgaatatattcactccctggctgagaggatctgggagatatgacactccaaaagccatgagcataacaatacccaaatcttagcttctaatggcccactttccaataaaaggaaccaggccacttggagaaaaggttgattccagggctaaggcaggaaaagatgagtcctggaacattttatgatgccaaaagcaaggaaatgctcaaggaatggctcaaaaaaaaagtcagcctaaaagggatcctactaagtctgagataatttaagcatcaaaattaataatgatagcagtgcattataacctaggcaataaaacagcaaaccatgagtccacactgatataaataaatgaataaaagaaagtttgatgaggaatgggatatctgcataaatgtacctccacacaaaatagttattaaagggggaaaaaggtaattatatatatagaagtttgacaaccaccatcataagcaagtgattaaaatgaacattatcagcaacgggacagatcaaatcccatgccacctgacaggatacaatgaaaagaacagagcatccctctgtggcattcccaccaaaggtgcacaacctgggccaggcacggtggctcacgccagtaatcccagcactctggatggccgaggcaggcagataacttgaggtcaggagttagagaccagcctggtcaacatggtgaaaccccgtctctactaaaaatacaaaaattaggcgcatatttgtagtcccagctactcaggaggctgaggcacaagaatcgcttgaacccgggaggcagagcttgcagtgagccaaaattgcgccactgcactccagcctgggcgacaaagtgagactgcatctccgaaaacaaccaaacatcaacaacaaaaaaagtgcacaacctgaatgtaataataagaaaacagcaggtaaacccaaagtgagggacatcttataaaataactggcttattgtctttgtgtcaagatcacaaaagtcaaagaaagactgagaaattattcacactcaagaagactaaggaggtatgacaactaaatgcagtacatgattttgaacttaatcccaataaagacattattgggacagttggcaaaacttgaatgggatctgaggaataaatggctgtaatgtgacaaagttaattttcttattttagtgactgtattgtggttaggtcgaagaatgtccttgtctgtaggaaatacaaactaaagtattctggggtgattaggttgacaacttacttgcaaatggttcggggaaaaaaaaggttatttaaactatatttccagattttccataatatgtgattatttcaaaataaattttaattttaaaaataaaaatatttgacagtatgtagttctacctccaaacattaaagaattacctgaacctgactcatggtcggatttagatctgatgtatgatgggagatgagagccaaatgctgacaccagactgctcaaacgaaaaagctaaatttgtgagtttttatgccctagtaaaattagatactactgtatagttagctattatctcatgtaaatgatttttgtaagggcctagagagaagagtctattttccagcctccaaagcaccatcaccatactaaatgcatagtgtacacctcaagatatttccataccataaaaatatgtctcaaaatattttaatgcttttaaaaaggagaaaatagtaatgataggcttactaggaacccattaatctcatggattacagcacagcacatacaacttccgtggaacacaatttttttctgttcaagttatctttgtgaggaatgtacaagatagaaaacaaatactaaatctttggtgaccagtaccactcctaaaagcaaaaggaaaaaagcaatcctctgcctctgggatcagaggaagattggccaagcagtgtcactccctatggcctgtcttggtgcctacagttacaccattaaagatttaggttaagacagtgtaaacaaatgacttattataatgcaaatattccagagtttcccattcaataaaagatactcatgaaatatataattatgatttataattatgaataatttattgaatatctaaattatttattgcatagatattaatgcttagtaataataagcattttatttcctcctgtgtaataggcactgtgatagatattttatataaattatctttaaccattccaactctacaagatagatgttatcacctccactttataaataaggaaactgaagcccaaagaagttaaatcacctgcatagcgccaaatgtcctttcagttgcagagtctgcattcaaactcaagactcggaatttttccattacggttttttcttttcttagagattgggtcttgctctgttacccaggctggagtgcagtggtgtaatcatagttcacagcagcctcaaactcctgggctcaagcaatcctcccgcctcagcctcccaagtcacagggattacaggtacaagtcactccattacattctgcttcttctttcactatgtaatttactattctgaaaaatagaacctggcgcagtggctcacacctgtaatcccagcactttgggaggctgaggcgggcggatcacaagatcaggagatccagaacatcttggccaacatggtgaaacgccgtctctactaaaaatacaaaaattagctgggcatggtggtgcatgcctgtagtcccagctactctggaggctgaggcaggagaatcgcttgaacccaggaggcggaggttgcagtgagccgagatcacaccacggcactccagcctgggcgacaagggcgaaactccgtctcaaaaaaaaaaaaaaaagaaaaagaaaaaagaaaaatggagatctatggtatgagggaataaaatgccatataggaaagcttcttattggtacaggataaaactaaattatgagacttctgagtttggggtagaagaagccaaagaatgccttagaaccatgaaaggaagaaaggctaagcaaagggacataagggcacaggaagaggggatgagaaaggtctaaggacaaactgcctggttccccagttttcctacacagcctaacactagagttgacaaaagtccctgaattaataatgagctcagttaaaaacgacaggcttagatttattggcctgaaagagatggatcataaatgagggctgtgggctgggtgtggtggctgacgcctgtaatcccagcactttgggaggccgagacggatggatcacgaggtcaggaaatcgagaccatttggctaacacagtgaaatcccgtctctactaaaaatacaaaaaaaaatagcccggtgtggtggcgggcgcctgtagtcccggctactcgggaggctgaggcaggagaatggcgtgaaccctggaggcggcacttgcagtgagccaagatcgtgccactgcactccagcctgggcaaaagaccgagcctctgtctcaatcaatcaatcaatcaatcaatcaatcaatcaatgctgtggtgaacactgtactttccttctttgtgtgaaaggaatgaggacaaataaatcccacgtacatggtttagatgtttgttccctccaaatctcataccgaaatgtggttcccagtgttggaggtggggtctggtgggaggtgcttggatcatgggagtggacccctcatgaacggcttagcagcatccccttggtgatgactgagttctccaaatttacatgaaatctggttgtttaaaagtgtgtggcacctccctgctctctctcttgcccctggtctcaccattttatacactggctcacctttgccttctgccgtgattggaagcttcctgaggcctcacctgaagcagatgccagcaccatgcttccagtacagcctgcagaaccctgagccaattaaacctcttttctttataaattatccagcctcaggtatttctttatagcaacacaagaactgacacactcgcccatctggaaacatgggatggacaagttattaaaatacctttgaagacaatagaagttagacaatatcaagcacctagaattttgggggtaaaaaattccacactgggtttttgtgggggttgttctggttcaggtttttttctttttgcccaggctggagtacagtggcatgatcatagctcactgtagacttgaactcctgggctcaagcaatgcttctacctcatccccctgagtagctaggactataggtatgcgctaccacacccagctatttttatttttttattttctgtagaaacaggatcttattatgttgcccagcctggtcttgaactccttggctcaagcaatcctcccgcctcagcctcccagagtgctgggattacgggtgtgagtcaacacacctggactaacactgtatatagtgaaaataactgacaagggcatatttttaaaatgtctttaggtgatttactttaccactcagttcagtttactgttcatgtgctatcaagaaacaaatttaaagcaaaatactgccaataatatgaaactgataagcacacaaaaataattgagaactatgtaggaactgaaatatattactatataattttgtagaaaatgtactttccatttacatgttggaaatatattggtatattcatattttaacataagatatgcattgatccctatggcactaggaagcaatacagcacaattgaaagatatctgggatcagaaacacctgaatttgcttcttgaatctgcatgagtactgattataaaactactgactttgtaactctgggcaagttattcaatttttctaaccttttcacccataaataaaaatggggaagacattgcaagacttgtaaagattgaagaatataattttatgtaaaaaaagtggcctgtgtgatgtttacaacattgcttataataataataaagtcaaaaatcatccaagtatctatcattaagaaaatattaagtaacaacagtatatacaccagattagtggttctcaaattttagtgcacataagaatgttctagggggttgtaaaatgcatatttccaggccttacacttagaaattcttagaatactcagaaatcctggggtgggatcaggaaataacacgtttaacaaacaaccataggtgcttctgatggaggacatctatgaaaagtatgcagtagatggaatacgatgatgccattaaaaataactatgaagactttgaaatagcattgaaaaggtgtatgatatacccttaagtgaaaaattcaggatccaaacttgtacgctttatctgataactacattaaacatgcttaagaaaaaagttgtttttagcaataagattaaaggtaatttttgatcttttactcaaagttttaaatagtcatgctattattataaatgaatcactaacacattaaaattgaaaaaaaaaaacacattggatcctcatggccttcaggattaggctcaaactccttagggcaacacacaaggtccttctatctccagacttagctcttgtccatgctccatatcaaactacttataataccccaagctatattctatattttcacacactattattgaatatactgttccttctgcctgaaatgccctttctccaacttgtctggaaaattcctattcatcccacaagattcaagcactacctcctctctgcagtttcccctgaatactcctccaagtcaaattctgggtgcctccttcttgctcctagtattcctacagcattatttggtatttccattgctccatatatcaccctgtattttacctttttgctgatagatctatcccattattctgcaagtacatggggtaggtagagatgatctcatttagttttagaatccacaaagtactcagcaaatacttgttaaaataagtaaagacctattttttgttatcactgttcttagttatcagttttctaaaaaatcctgagtgccctgctggttagttggataacacttggctcaatgattaatgagctttgtctaatatatacatatatatatacacacacacgtagcataaaacaaacccatgaaaaatttttaagaaatagtttaaccattgtttgtaattcttcacgttctctgcttatgtcttcaaagtttctatcaaccttcaggatgacagaccactctggtcaatagccaaagcaggctaacaggaataactctgctctgggctcctccattgctggagtttacccagccaaagaacatccctgcagaattcttgctgcttcccccaaacacactcccactcactgccatctccgcactagcagtaaaatatctatataaaacagagataattctgtaagtaaatagagcagttttttagtatattcaaaacactagatactatatttagtatatttgtgtaatacataaaacatttcaaatgcagattactaactagaggtaccaaacaagaacctaaagtgactaatagtaattcaggccaaaaaaaaaaaaaagaaagaaaaatcaatgtggaagaatactaattgagatccaggtatcagaacttcaaatgctttccctgtaccgtaaaacataagttttaggaataacctggatgctgaagccaacttgcaacacaatttttttaaaaagaaaaacaaaatacattttttaacatttgaatctcaagccacattaggcattaaagctgtgatacaactttgttccatatctctgtcacctgtgatataataaatgtgtacagaaatacttttagtgcacacttcatagatactgtacttttttaaaaattgaagatttataggaaccatgtgtctaacaagtccatttttccaattaggccaatgtgctcagttcatgtctctgtgtcacatgttggtaattctcacaatatttcaaactgtttcattatttttatatctgttatgatcatctgtgaactgaataatgctgtgtgtgttctcaccactccaccaactggccattccatctctctccctctccttgggcctccctattccctcggatacaacaatattaaaattaggccaatgaataacccttcactgacctataagtgttcaagtgaaaggaagagtcacacgtttctcactttaaacgaaaagctagaaatgaataaacttagtgaggaaagcatgttaaaagtcgagacagactgaaagctaggcctcttatgcctaacagttagccaagctgcaaatgcaaaggaaaagttcatgaaggaaatgaaaagtgctactccagtgaacacatgaatgataagaaagccgaagagccttattgctgatatggagaaagtttgaggggtctggatagaagatcataacagcaacacaacattcccttaaggcaaagcctaatccagagcaaggccctaactctcttcaattccatcaagagctgatggagctggggaagctgcagaagaaaaatctgaaggtagcagaggttcagggggcttaaggaaaaaagccatctccatgacataaaatggcaaggtgaagtagttaaatgctgatgcagaagctgcagcaagttatccagaagatctagctaagataattgataaaggtgactacactaaacaacaaaatttcagtgtagatgaaacagccttctattggaagaagatgccatctaggactttcatagctaaagagaagtcactgcctggcttcaaagcttcaaaggacaggctctcttgttaggggttaatgtagctggtgactttaacttgaaaccaatgcttatttaccattccaaaaatcctagggcccttaaaaatgatgccaaatctactgtgcctgtgctctgcaagtggcacaacaaagcctggatgacagcacatctgtttgtagcatggtttactgaatattttaagcccaatgttgagacctaccactcacagaaaaaaagattcccttcaaaatattacagctcagtggcagtgcactagtcacacaagagctctgatggagatgtacaagagactagtgttgtttccatgcctgctaacacaacatccattctgtagcccagagattgaggagtaattttggctttcaagtcttcttatttaagaaatacattttgtaaggttatagctgccatacctagtggtagctatagaaccactaagaacatttgcgggccaggtgcagtggcccatgcctgtaatcccaacactttgggaggccaaggtgggaggatcacttgagcccagaagttcaagaccagtctgggcaacatagggaaaccctgtctctacaaaaaatttaaaaattatccaggcttggtagcacatgcctgtggtcccagctacacaggaggctgaaagcaaagaatcactgagtctgggaggtcaaggctgcagtgagcacagtgatcatgccactgcactccaggcctgggtgacagagtgagaccctatcacaaataaatagataaaacatttgtggttcatgggaggaggccaacattaacaggagttttggaagaagttgattctaactcttatgactgattttgagggattcatgatttcaacagaggaaggaactgcagatgtggtggaaatagcaagtgaaatagaagtgaagcctgaaaattggactaactgacaacaatctcatgataaaatttgaacagataaggagttgcttcttatggataagcaaagaaagtggtttcacgagtggaatcgactcctggtgaagacactgtgaacattgctgaaacatcaacaaaggatttataacataacataaataaagcagcagcaaggcttgagaggagtgactccagtgactccaattttgaaagttctaccatgggtaaaatgctatcaaacagcatcccatgctacggaaacatcttttgtgaaaggaacagtcaactaatgtgaaacttcattactgtctcatttaagaaattgccacagccatcccaaccttcagcaaccaccattctaatcagtcaccagccaacaacattgagacaagaccttctaccagcaaaaggattacaacttgctgaaggctcaaatgatcattagcatttttagcaatgaagtattttttaattacgtacattgttttgttagatataaggatgttgcacacttaacagtacaatatagtgtaaacataacttttatatgcactggataaccaaaaattttgtatgactcactttattgcagtggtctgaaaacaaatccacaatatgtctgagctatgcctgtacatctaagtaataacgtctgatataggcaaataatatatgtttatatctaaaatgggtttatataatccaataaaaaattctagagactaaatgagtagcaaaaagaaaatacttttctatcaccagccatatactctctcatttctcatgtctccagtcaaatcccttccccttcagcctttaagaaggaagaattagccaggcatggtggttcacacctataatcccagaactttgggaggccaagtcaggaggatggcttgatcccaggagttcgagaccaacccaggagttcaagaacagcaaggcaggaggatcacttgagccctcaacaacagaccccaacagacagggtttccctatgttgcccaagttggtcttgaactcctggattcaagtgatcctcctaccttggcctcccaaagagctgggattacgggcatgagccactgtgcctggcccacaaatgttcttaatggtgtctagcatggtcaatcctttccagaaggttttcaatttactttgcacagattcatcagaagaatcactatgtatggcaggagtttgaggaacagtgaggctctgtccttataaaaaaaaatcaaaaaattggttgggcatggtggcacatgctggtagtcccagctacttggggtctaagacatgagaatcacttgaccctggggggcaatgaggctgcagtaagctgtgattgcaccacagcaccccggcctgggtgacagagtgagaacttgtctccaaaaaaatggaagaattaccacctgtatccaacattctcttacgagcctggcaaaatccactccatttgttctgccagaagaggtcgatggctttactattttggcctaatgttttgttgcctctttaaatgaaaatacgaaaagagctgcttctttctaaaagctttaccaatcaattacaacttcactatgaattaactgtcaggtcccacaaacactttttggtggtaaagaaaggaaagaaaaggcactgggtccatgacgttagaggataaattaacattgaggtataagcattccctttcctctgcagcctcaccagcatctattgtctttcgacttttaaataacagccattctgactagtgtgagatgctatctctcactgtggttttgatttgcatttctctgataactagtgatgctgagcattttttatgtttgttggccacttgtatgtcttcttttgagaaatgtctgttcatgtactttactcattttttaatagagttacttgttttttgcttgttgacttaagttccctatagcttctggatattaggcctttgtcagatacacagattgcaaatatcttctcccattctgtaggttgtctgtcagtgtggaaggtagtacagagatttctcaaagaacctaaaattgctaccattcgacccagcaatcccattgctgtgtatatacccaaaagaaaataaatcattctaccaaaaagacacatgcattcatgttcattgctgtgctatgcacaatagcaaagacatggaatcaatctagatgcccatcaatggtagactggacaagaaaatgtggtacatatacaccatggaatactaggtagccataaaaaagaatgaatccatgtcctctgcagcaacatggatggagctggaggccataatcctaagaaaattaacacaggaacagaagaccaaataccacatgttctcacttataagtgggagctaaatataaagcatatgtggacataaataagggaacgaaagacacagtggactactagagggtggaaggggggtagattaaaaaacagcctattaggtactatgctcactacctaggtgacaggatccatgctccaaacctcagtgtcatgcaatatttccatgtaactaatctacatacatacttcctgtatctaaaatctgttgaaaattttttttaaatattcagataggctggaatctagagatgatgccagctggcacaaaaactggagccagggtgaacttgtagtaattagaaaaaaacgctttttttctgagatgtgattgaggagggttaaagggaatgtggtgtgggaaatagaaacaggaaaggaggttggctgtttatgctcacatccatcaatcaagatttgatccaatttgatcaaagaatggtaacaagtctaagcagtttgtttcagttcagttaactagaagtgattaaccacttcaaataaagctactctcataacacaatagaatccaaataactctactgcacagcttaatcaaagttccatttcacaactagatccatgaagacatgtcatttaataagaaacatgattcataagaatcagattcagagatgaacactctggacagtgcagtagaagaaacagagtgtcttagtctattttgtgttcctataagagagtacctgagactgggtagtttacaaacaatgtatgtttttgtgattcacatttctggatgctgggaagtaaaagagcatggtactagcatttgctcagcatttggtgaggaccttcttattgcatcatcccatggcagaaggcagaagggcaagcaagcatgggcaacagaaagaggaaattgggctgaactcattattttgtgaggagcctcccatgacacctaacccactcccacaataatggcattaatccattcatacatgcagagccctcatggcctaatcacctctaaaagatctcacctgtttgttttgtttttattttgagtagggtctcactctgtcacctaggctggagttcaggggcatgatcattgctcactgcagcctcaaactcctgggttcaagcaattctccccacccagcctctcaagtagttggggctacagacgtgcaatgccacacctggccattttgttttgttttgttttttatagagacagggtctcactatgttgcctaggctattcttgaacccctggcctcaagtgatactcccgtctcagcctcccaaagcctgcgattacaggtgtgagccaccacgtccagacagatcccatctcttcatactgtcacaatgacaaataaatttcaacatgagttttggagacaacactcaaatcatagcactgtggaaaacaaaatttatcctttggtcatattttttgatccatcttcaaatatcaattaaaagcctcatccagatttaacacaaatgtaaaatgtatttgatatcctactgacaccaaagaagaaaagtagactcttaagaaaagtttctagatctgtattacacaagaaaattcaatgagttttcaactggcattgtgcctctgcctgcccgtacggcttacataaccatgtcctcacatgcatgagaaagaactggaagatagaagcgtcttctttgtaaattcctttttcaaatataaaatattctcccatatcaacatatgatgagtaataaaaactcactgtattttaattaactaacatcattctgcaatatgtccaaaacggaaactaaagacactctaaaatgcattaagtgttaaatatcttcaggttccataggttgaaattagtcttttctaacctttgtctggcattatagtcagcttccatttctagttaaatactcaggaataatgttctatcataggcttctgatagaattttccaaaattacctcaaaattatttcagtatataactgaactaatcaaattgtttactgtcacctgaaaggttaagttgctaaagtcagcagaggcactaataaatattatatgcttctgccttaatgtcagtgaagacttgcatcagcctttgtcatctgtaagaaatcgagtcacacaagaaactgtgcaatggatggacaggttgagtagtagtcactggctggctgccctagttcactgctacacatcaccctcagtgttttgaaaagggagctgaaaaccctgctcagtggagaaagaggtcaataccaaaattcaccctcctttctccttactccccatcatgcagctggcactgttcactctggcagatacagctccctgaacataatggtgcaatcaccacttcaaacatcattactatctaaaatagataacccacttgcaacttgactatttttatagatataacattttcatggagcttaactgctctatttgtgatttattccatttaaccaatgcagtttccctgaaagtgagtttcttatatcagggtcccaataaccacaattgcccaaatagttgtgaaaattacagtacttcctagttgtctgttatctccctgtattcatcaccaaaatgacatgagctgaatcctaaatctgaaaaattataagctctctggtttttatgtttttggtgaccagaagattgttttgctccacttcttattgatctactttttcacatggggatcttaagaactgtattatttatttctgacaagaatttactaaatacaccttatataaaactcaactcttcgaggcattaagaaaatcaaataaattgaggcattaataaagttttatcactgtattaaaatacaaataattctctatcctatactcagcaaaaaattaattaaatatacattttaaatggaaattagttttgtttagaataaaaggtagttgtgccaaaggaagagaggtttttttttaagattttgcagctgtctcataaaagatatgttaaataaactgaaatttcacataaaatgtagaggaagaaaaggagggaggcaactcaattttagtgctctgatgagctcagatttctttaaggatgaaagggggtagtaagaggtataactgcaagcaaacacaaaaaaagaaatatatacttgtccaggaaaaatgctaatgtcctttttagctaagtttgaaaaagagaaaagaggtgtaacagttcactaatttcaccttcagttctggcagagtaaaaggaaaactgtgggtagttttaaaccacaagataattttctatgatatctaacaatgccaagaatctaattcttcccaacttttattttgcttctattttccctattgagaaccattttcaaatcagaagggataaacaaataacttcaggagattactgaaggtccaaacgagaccataagggacagtaagctgctttaaataagtatgcatatccagacccagaagaattagatgcaagagggtagaaggaatttttgccaatactaggaattaccaatggctcactgccagaaacaagccataataaagtagactgattttgatggaatttaaaggatagatcaaaagaatgccatacacttaaatacagtgtgaatttagaaaggcagtagataaaatacctcacaatattctcacaggaacaatggagagaaatagctgattgtcattgcgtggcttcaatcctggtagaaataccatgagtaaagactgttacttttaaatttatactaagttgaagagaggtgctttggggatatagcacagtgtgttgaatttaggttatagaaaacatgcttattacatctctggatgatacaggggagagaagttaatacgctgaaagacagactcaagagtcagaaagaagaaaaaaaagagtcaaaaagatatagagaaattacaaatacaacataaaacaaatcagataaaaaggaacaggaataatttaagctcaatcaacacttttaaaagtaccagaaaggggacctggcttcacaggtcattgaaaaaaaaaaataccaggaaattttaattgactgtatgttcaacatgagccaacaccattacatggcccagaaaatcttgacctgtaggtaggtcttagatcaataataaagagataataatttcattgtatcatgttttaatagctgctattttattttaattacataatacatattcattacagaacactgaaaataaagcccaaccacaattccaccactcaaagatgaatactatcttcattttggcatcttatcattccagacttcttaagcacattataagtgttcaaacaaacttattttttcttgcaaaaataagatcatactataaatgcttcttgtaacctgctgtccttggttttcttattcagccataatgttctactctggtcaagggacatctactgcattttgtgaatttctagtcaccatactttaagagggtcattgcaaaatttgagaatatgtaaagaaggaaagagagagtagagaaaagtatgaaaactaagttcttaacatctatgctgtcttgccatataaaaggttaacagagatgatagctcttccatgaaaaatacttataagaaaacaaaaatacatgcatctaaagaactatcctgcagatgaattagactgctttatattgacccatacagccaatctactaccaattgctgaaagtcacagggaagtggattttagctcaatgaaaagaaaaattttaaaataattacagctgtcaaaaatagaatgaatctagtcattggaaggtttaacagggctggaataactaacaggtaagaaatgttacagagaaaatttccgcactaggtgagaagttggaagaaagttccctccttatttgacgattctatgattgctatgggaaatttactcccagtccaataggaagcaaatctttagtcattaaggccttaaagaatacagtcaagtgctttagaggtgcatgaaaaatattaacactaacgatgaacacctatatgctaaatgttttgcattcattactttatacttcatttaatccttataatgatcttatatgataggtactattattactatttccactctgatagaatagtgaggcttagagaggtttttaaatttattcaatggcattcttacatttgctgaaaattgcagtgccacccaaaagcatacctgattccccattacatagttactgttgaaaggataatttcttattaccagtagataacaagtaatcagaagcatcttcagaaaagttcttgtctagtgaaccctcaaagggcagttgtgagatttttttaattagaaaaaaataccaaaatttaaggaatttcaaattattcttcatagcaaaaaatgttcagattggcctgtctaaattggccacatacctttaaacttttgtgaataaaacagattcaatgaatgagacttaaaatgttgtaaaacaaatctgaatcacagattttcaaatctttgccattattaattaagtgaccatgggcaagtccttaatcttatctttttattccttcatctgtgaaatgacaatggacctcctaaggctgacacaagaattgaatgagatgacacgtgtaagcacttagcatagggtctgacaccattattacacaacccaggtaataaagcaagcggggaaaaagtgccaaacatattctacagttccttctaaaacattaagaaatttcaaagtgtcattatgtttgacgggggacacattttccattatcctgccaataaatttctgatgacaatcatttttgaaataaagtgacaactaaataaaatgtgccttcttaggaatgtcattttatgcaaatgattgcccaaagaatacaatttcaactctcattttcttcagacactattcagtataagatggataaaagcaagtttaaaggttattggttttgtttgtgatttttacaacttggttcgaagtactctaataaacacatgttgtttacttttgttttctatgtgcaatctttgttgtagagctactactactactactacaccagcaaaagagaaaacctctcactcaagatatacactgtgggtcactattttgatactttagtgtccactaacattaaatacttggtgttttatccctaaaacttgacatctattctttaaaaaaaaaaaaaaaaatcacagctgggaaaggagtatttaaaggatgtttgcttttgagttttgtcacaaggagtgtttttaaaatacgatttatcacaataaaattaagtgaaattctcactgttctcaaataattcctcatgttttcccgaagaaattgtttattttgagaaaattctttcagcataccagtttttagacataatcatttttataactgatggatccacagcaaacgttgttattttacgtgtaacttaaaactgtaaagagataaattgctttcacataaactacatgtgactacaggcaattattagagctgcaatctgaaatatgcacacattgtctacctgtgtttgaaagagaagattatttaacaagggagtacacacaagtcatctctatgacctattgaaaaaatgtcccataaatattcattcttctgacatgaactatcattccaataaaatgtcactgtcaacgagtatatagaataacatatggggctttttaaaatcccatcgactatttttcaactcaatttatttcactgtaatagaaactttccattttcccttttagctagccctataattaattgcactgtctgaccaccacaacctatgagaacttgtgtaaagaacgcaatgtcatcacccaaaagtttctattaagcacttgtcaagggtagcatggaacagtttttaaaaaaccagggaaatcacttgggctttctaaaatttttacaactatagttgggttatccaagagatgttttaaggcgaagatatgaatgacaattgatgactccaaaaatacccaggataaattggatagccacgattttagaaactaaagagcttcccttgaattgtatctagtgaatactctccaggcttcctccctcccagttgatttcatttgtccatcaatacaacttttaatagtttctcaagtatggaaatcaaccccgctatttccaaggtactgctgaatgaagaccttgacattttttttaaatgtcatcttagaaagattctccaagcaataccagtctcacctacgacatcttcacgttaaaaggcctctaccgtactccatatacagtatcccaataccaacctggcatccttcatcctgagctataacaaccaagtttcactcagctatgtccaggtaactgaaagtattgctggggctgcctaacctgccccatcaagttttatacacaccctgtgctgaagacatctcaccagaaagaaggttcactcacttcattttgtgggatcataacccacggcacagcaaacgccttctgcaagagaaggtaggagccaccgaaggctgtggcttttgcagggtaattgcatgcacgcaagagattctctgccaatttcatttaactagacaaaaaaggctgcgttcaaagctgcaaatatgtaataaatgttgatggaaagcgggcggaacgtcgattttcttcaagcaacactagtacatgtacaagttctgcaccagggctcagaggaaaagtagcttactgacgcattgatggaaggctattttaaaattactcaaagaatctaaggcatcaatctgactgggaggctcatacctcctctccatacacgcagtctgttttcctacctaatttaagaatgaatcgctggcagccaccaggtgcaataaccgtgaggaggaggacgtatatccatcacaatgcataatgaggtgtgccaaccccggagctggtgcccgtccttaccttagcagattagacaggggcaggggtccggatccaccgcccaggatccctcctttcctgccagacaggagtttctccaccagagccacatttccagtgcgagcagcttccagcagctcctggtccttccccatagtctctcaccgactcccccacagagtccttgcccccctcgggtcctcctccccacccacccccactccccaaaatccagggccctcttcgccccaccctaaaataatgcaagagcttcagcacggagagctccctgcagccccaggcagggagcacgactctctcctcctcttcggggcgcagcttttacaatggggatcagaccatgtcttgaaagaggggctggccgagctgggagccgcgacgcgcccccacagccactcccctgaattcccaaggcctcgttcccgcgggtgcggcgtgagggggtggggactcgggggtgcttttgaggagcgggaggagggtggtgaggactgaggtcggaggaggaggaggaggcggcagagagagtcctagctggagcgggagcgcagggaacacccgcggtggcagcagcggcccgcgcgccctcgcgcccgacccgggctcgcctcggcttcctcggcggttacgcgggggcggcgtccgcggcggggaggagcgcggcggcggcggcggcggctcgtgcgctgtggcccgcgccgaggcagggcggtggggggcagccgcagcgggcgcgtgccgagggcggcggcggcggcgaggcctggcgcgcggggggcgtgtgcgcgcgggcaggtgcggcccctggtgcggcccgagttgggtggcgggctggcggggaggggccgggccggctgaggcggggcttcggccctgagattctcttcgttctcgtgggcggggaccctccctcctccactctccttggaagagcgttaaccgtgtgaggactggagttccccgggccgcgtcggctcctcctcggcccggcgggccccggcaacacgcctcgggtctgtcacgacgcctgaggaaaatcctccgtgacaggaatggggaggctggtgacactggggaggggccctttggccaccgcttccatcagagtctaggcaacttgaccggcatttcacccttccgctttacctccccaagagagcctgagatctgcccttggttagaaagaagaggctcgtttcgtcctagtttctgtggcactggccaccgagcagtttgcgactgtttcagtttttctggagtctttaatcagcccatattttagttgggctttggagatctgctgacttgtaagaataccaggaaaaaggctctcattgaaaatttatccacatctacactcgaaaaatataaatgggcatggattagagatccactttaatttgcatatatcatcagcaattcattgtgcatggttggcatgacttgttagatgctctccttggccgtggtggagaacgcgcgtttattttctattaaaacttcctgttacaccttgtgctttgcattgtccttggaatagacttcataaatgttcacttgttgataattgattggtaagaagaggacttaataggcactgtgcttacaacaacccagtgaactggatattattatatccattttagaaatgaggaaatagggctcaaatggttaattaaatttctcaagatgccacatggagtaagtggctgactcagaactagaccccagaacagactcactccagacaccatgtgcttcccaatatacgttcctgccccccatggaaaagcgaaatggacagacaataattattgcatgcatttgatgagtagttgctacataccagacactatgctaagtgctttccatgttctcattaagccttgcaacaatcgcatgagataggaccattttcatctctattttggagatgaagaaactgattacccgcaagataatagggatagaaagtaactgagccaaggctcaaatccggcactgtctgctgtaggcaaagattttcaataaataactgggggaaacttaaaaggcatttagagataaataacaagagtatattaaaacatttttatggaattcattgtgttctgagatttcatttcaatgattcaaaatattaggtaaattatggctatttattggaggtttcctgaagtatgtagattttggctagtgtagttttttaattcattttgattttgttttctgtgttagaatctgttttaataagataatctatgttataataatataatccctgacataatgggactagcagaccaatgaaagaaacgagataaggagccatcacattcattttgaaaatggcatagggaaatccttcttcctttttcctaatgttgccacctaagcaaaacacacctttcccagaatatactgtaagtattcaattggtcagaactgaaaatcacccacagttttcacaagcaacatttaatcatggatgagttggtgaccgcaggccccgagtcatcttatcgaaatcatgcagcccccacccccaatgggaaaaccattagtaatgatttactctaagaatcagttccacagttcgggcattctactgacatatgataatcaaagccaatttttcagcttcaaactctttggttttagtgacctcataactttgtttttctgtagacattgcagtgactgcacctcatagttttttgttgaagaggataaaggctttggctacatggggactaacatgcaaaataaaagtgaaaacattcttttaaaaatctacagaggccaaaataaatatccagatcttttaaacatccagatttcatcaagatgttttgcatctgtgaatagtgaaaagagtgatagaatcttgggaaccaattagacaatctctatctcagtgtgtgcataagtaaaatgaagaagttatgtcggatgccttccactggccttgccagccataatattctatgcctgtgatgaaacgtggtcttagtccattaagtcatttgcatcactgaagctagaaattaagtatggagatagatttgagatttctattctgtttttatttgatttgattttctgagacagagtctgactctgttgccaagactggagtgcagtggcacgatctcagctcactgcaacctctgctcccaggttcaagtgattctcaagcctcagcctccccagtagctgagattagaggcgcccaccaccacgcccggctaatttttgtatttttagtagagacaggatttcactatgttggtcaggctggtctcaaactcctgacctcaagtgatccacctgcctcggccaccctctattttgtttttaattataaaataaatatatattttttcgggtttttaaatctatctttgctattctcaatggacagtattaataatagcaaatgtaggccgggcatggtggctcatgccagtaatcccagcacttttgggaggccaaggtgggtggatcatgaggtcaggagatcgagaccatcctggctaacatggagaaaccccatttctactaaaaatactaaaaattagccgggcatggtggcgggcacctgtagtcccagctactcgggaggctgagccaggagaatggcgtaagcccaggaggtggagcttgcagtgagtggagatcgcgccactgcacttcagcctgggcgacagagcaagactctgtctcaaaaataaataaataaataaaataaaataaaataataataatagtacatgtgtattttgtgccaggaatgatactataccctttactttctctcattttatttaattctgaagtaacactgtaagaagatattataagtcctgcagaatctctgaatcccttatatttcaaattctgatataaatctacttctggatactttttggcaagaattattgctctaatatacacatactgcaagtcactcttctaggagttgattaataaaagaagggactaggggttgagattagaagggggaagtgaagcaaataccagtttttgtatagaagtgtttgcacacacacacaaaactctttggaaacattaaagaaattgaaggaccatgaatccagaccaatcttagaattatataccaaggtctgttttcagtgaagaagagaaaaagataatatcttataacatgaagttatcaacagagctgaaataagaagataaccctgtgatttatgaagtagatttactttctccatctcaagttctgaagttactctgcatcactagaactatgaagtcaacagcttcaggttacagaatgtgaaaatactagacatctggatagaagagcaggttcttgcttcctgcatgacattaaagttcttctccacatggccacatggcacaaactctgtccctcatcatcttcctgagggaacccaaacaccaagtgtattatatttacaatttttctgaagattcatggccatgaatgttgaaggccacagaacaccaatcacccatcttctccaagttataattagctgaacgcagacacaaggaatcaaagagtatctcattagcatatcatctttattacgagtcatataagggtctaatatcccacaaaatccctgctaaaactacactaaaaatgagacgagggcctacctctctgtgaatgtgcaccttgggacctacctgtggggaaaggtagatctgcaaatctaaatgtatatacccagccagactaatgcctatctcacagataaagtcagaggaatggagagaatgatcagtttccagggctgcctttggaaagcatgccgaaacagattcttaccccagaatctcaccatcttgggacagcaagcagaataaagcccactacccttcttagtgatccatgagacaggcaagagagaaagaaaaccagagctgagcctgtatcttgttttgaaagcaaggtagccccacccactagtaaagtggtcccaatggatagaagtagggaaagaaaccagaagtgttcactgtcttagaaagaggagcagagcctcctctcctctagggaaagtcagtgatgaggaataagagttcccccaggaccgtcacactacacaacattccatcaccatcctgctgattctaccattaactctctccgagccaccctgcctatgtgctactacctttgaaagcctatgtgccccacaggtgaccctgcacctggccagctgaaaaaatatagtcttgtatccacttcaaactattttcccaccaagagaatctacccaaaattcagataaatgatttttcaccatttctttttatttccccactgaggaaaatacctagcatcctgacaaacctattacacagtctctcagaggggccgctaagaagacacacaaacacattatccatttttggcatcttaactgatctccctgaaaggctaatcccaatctacctccttcttagactccatcctttccttcttctgcgcagtgatccacaaactttttcgtaaaaggccagagagtaaatattttcatctttgtgggcacacagtctctattgtactactaaattctgccattgtagcataaaagtagccatagacaatactgaaacaaattagtgtggctgtgatccaataaaatgtcatttatggatattgaaatttgatttgcaaaattttcataggttacaaaatattcttttgacttattttccaacaatttttagaaagcaaaatccattcttagttcactggccatacagactgtgggtgggatttgacccacgagccataagcctacagattgaagagtgacgtattccaaagcccttttggggatactgctttctcccttggtctgattgtttagacatgggggcagggggcagaatcaaattgttccccttaaggcatctcttccaccccagcctcagcagacagagaacctccccatcagcaaatcctctctaactctcctatatctcaagaaagacccttaggccaggtgcagtggctcacgcctataatcctagcactctgggagaccaaggcgggcagatcacctgaggtcaggagttcgagaccagcctgaccaacatagtgaaaccccgtctctactcaaaatacaaaaattagctaggtatggtgacatgcacctggagtcccagctacttgggagaccaaggcaggagaatcacttgaacccgggaggcagaggttgcagtgagccatgatcatgccactgcactccagcctgggtgacagagcgagactccgtctcaaaacaaaacaaaacaaaacaaaacaaaacaacaaaacaacgcaacaacaacaaaaaaccctttcttggggtctctatcatggtcacattactgagacttttgtattgtattatactggtgtgcccttctttaccatgaacagattggagaaggggcccccgctgagctgaaactcaacctatgaggagagggatgatgatgattcctgacatcagacaaggggccccacaggactaagacccagacctcttaggaggaatcaccggctgcttggtactagtgtctctgaggcaaagcaacaacgctggttctgcatattagaaaaactgcaaactggattcaaccgctgcttctggaacaaactgccactgccatgttgaagaagtgcagtctccctctcgcatcttttattggtagatcctcacagaggacaaggtggcaaagcagtaatatggtttgcaggttattataaaacagagtgatgagaatgggcttaaagttaagaggcagcagtgcaataaaaggcataaagccccctttaaaatcaggttaaaccagctgcatttcttgctaccatcatcactaaacttcacaaccagtgttttactcacaacttctgagaattcttgatttcctgtctccactcctaaggctcctggtcttctgtctccactcctacaactcatggaactcttggattctgtctcctgctctggcccagtaaataactctaaccagtacttggttccatgaaaaacccgatcattttctaaaaatctgaagagtgacacactgaataggaaaaactcaaactgtttctcctctgctctcacaccacaacaatcaacaccaaagacatctgtgaccaaatgtgtggagatttgcctccatcagtaagcaagcaatcagttctggagcggacaccaactgggtgtcctctaattcaattcaattctgacaccatctacctagagatagtgtcagatcccacaggttgagggctctgtccccaaggctgctcccctctttggatgccagtcacaaggccccagttgttttgtctgtgcttctgacccacctactgactacatatcagtgataccacccctccttgggttcaactaatttggtagagcaggtcaattaattggctggagtggctcacagaactcagagaaacacctccattttcccgtttattataaaagatatcacaaaggatacagatgaagagatgcgtagggtgaggtatgggagaaggggaaaggcgcttccatgacctccctcccggggtgcatcaccctcgaggaacctccatgtgtccagctatctggaaactctctgtgccctgtcctcttgggtcttttatggagatctcattggataagcatgactgaagcataaacaactgcacagaagtgattggacaaacaggatataatctaatactattagactgattggagaaacacagcagggcctgttcagattcttcttggccactctgcacagcagtccttcctcctgggtatggggcaggacctcttatcaaatgcggtcatatgaccttcaatcagttttactggagagtttctttatggaaagacagggggaaattagattactgccttggggagaaaaaggagcaggtgacaggagggcaggagaagctcatagagagagattctgtttgctaaggcctatttctgaggcctaaagcaccccgacattataaaaaaagattttaacaagggctttgggaattatgagccaggaacatgaatgaaaaaatatatgtgtgtgtgtgttatattgtatagatatcttacattgtttctcaaagaatttcaccaacccaaccacctgctaagactcattcgtctccagagctgtcttcatcaccctctgcctctgcccaaaggctcctgagtccagcagttgactttccctcccaacagagattccctgagaattatagcccagtggtagcccaacatgttccaaatgtttttctgggcagcattgtctttggattttgataaataaaatttttattattttattacatctgcagaaaggaatatataggcatctccttgaaacttcgaaagagattggttaaaagcagtctatgtacaacgtaccagaatctctggaacacatttaaagaagtgtgtacagggaaatttatagcactaaatgcccacaaaagaaagcagtaaagttctaaaattgacaccctaacatcacaattaaaagaactagagaagcaagagcaaacacattcaaaagctagcagaaggcaagaaataactaagatcagagcagaactgaaagagatagagacacaaaaaacccttcaaaaaatcaatgaatccaggagctgcttttttgaaaagatcaacaaaatggatagaccgctagcaagactaataacgaagaaaagagagaaggatcaaatagacgcaataaaaaatgataaaggggacatcaccaccgatcccacagaaatacaaactaccgtcagagaatactacaaacacctctacacaaacaaactagaaaatctagaagaaatggataaattcctggacacatacaccctcccaagactaaaccaggaagaagttgaatccctgaatacaccaataacaggctctgaaattgaggcaataattaatagcctactaaccaaaaaaagtccaggaccagatggattcacagccaaattctaccagaggtacaaaaaggagttggtaccattccttctgaaactattccaatcaatagaaaaagagggaatcctccctaactcattttatgaggccaacatcatcctgataccaaagcctggcagagacacaacataaaaaagagaatttttgaccaatatccctgatgaacatcgatgcagaaatcctcaataaaatactggcaaaccaaatccagcagcacatcaaaaagcttatccaccacagtcaagttggcttcatccctgggatgcaaggctggttcaacatacacaaatcaataaacgcaatccatcacataaacagaaccaatgacaaaaaccacatgattatctcaatagatgcagaaaaggcctttgacaaaattcaacagccttcatgctaaaaactctcaataaactaggtattgatagaacatatctcaaaataataagagctatttatgacaaacccacagccaatatcatacagaatgggcaaaactggaagcattccctttgaaaaccagcacaagagaaggataggatgccctctctcaccactcctattcaacatagtgttggaagttctggctgggacaatcaggtaagagaaagaaataaatggtattcaattaggaaatgaggaagtcaaattatctgtttacaggtgacatgattgtatatttagaaaacctcattgtctcagcttaaaatctccttaagctgattagcaagttcagcaaactctcaggatacaaaaccaatgtgcaaaaatcacaagcattcctatacaccattaacagacaaacagaaagccaaatcatgagtgaactcccattcataattgctacacagagaataaaataccaaggaacacaacttacaagggatgtgaaagacctcttcaaggagaactacaaaccactgctcaacaaaataaaagaggacacaaacaaatggaagaatattacatgctcatggataagaagaattaatatcgtgaaaatggccatactgcccaaagtaatttatagattcaatgccatccccaccaagctaccactgactttcttcacagaattggaaaaaactactttaaagttcatatggaaccaaaaaaagagcccgcatagccaagacaatcctaagcaaaaagaacaaagctggaggcatcatgctatctgacttcaaactatactacaaggctacagtaaccaaaacagcatggtactggtaccaaaacagatatatagaccaatggaacagaacagaagcctcagaaataacaccacacatctacaaccatctgatctttgacaaacctgagaaaaacaagcaatggggaaaggattccctatttaataaatggtgatgggaaaactggctagccatatgtagaaagctgaaactggatcccttccttacaccgtatacaaaaattaactcaagaaggattcaggacttaaacataagacctaacaccataaaaaccctagaagaaaacctaggcaataccactaagaatataagcatgggcaaagacttcatgactaatacaaccaaaaccaatggcaacagaaaccaaaatagacaaatgggatctaattaaactaaagagcttctgcacagcaaaagaagctatcatcagagtgaacaggcaacctacaaaatgggagaaaaatctttgcaatctacccgtctgacaaatggctaatatccagaatctatgaagaacttaaacaaatttacaagaaaaaatcaaacaaccccatcaaaaagtggacaaaggatatgaacagacacttctcaaaagaagacgtttatgcagccaaaagacacatgaaaaaaaatgcgcatcatcactggtcatcagagaaatgcaaatcaaaaccacaatgagatactgtctcacgccaattagaatagtgatcattaaaaagtcaggaaacaacagatgctggagaggatgtggagaaataggaatgcttttgcactgttggtgggaatgtaaattagttcaaccattgtggaagacagtgtggcaattcctcaaggatctagaactagaaatatcatttgacccagcgatcccattactgggtatatacccaaaggattataaatcatgctactttaaagacacatgcatgcatatgtttattgtggcaccattcacaataacaaagacttggaaccaacccaaatgtccatcaatgatagactggattaagaaaatgtggcacatatacaccatggaatactatgcagccataaaaaaggatgagttaatgtcctttgcaggaacatggatgaagctggaaaccatcattctcagcaaactatcacaaggacagaaaaccagacaccgcatgttctcacccataggtgggagttgaacaacgagaacacatggacacagggcagggaacatcacacactggggcctgtcagggggttgggtgtgggggacggatagcattatgagaaatacctactgtaaatgacgagttgatgagtgcagcaaatcaacatggcacatgggtacctatgtatcaaacctgcaggttgtacacatgtaccctagaacttaaagtataataataataaaaaaagaaagcaacaacaacaacaacaacaaaaacccctctttaggtgatcaagttcacagagaataacagccaaagcttatctgaaagctttgattgtgccagatatttcacatggatcatttcatttaatccccacaagctcttgaggcataagcttttttttttttttttttttttttagacagagtctctctctgtcacccaggctggagtgcagtggcgccatcttggctcactgcaacctccatctcctaggttcaagcgattctcctgtctcggcctcctgagtagctgggattacaggcatgcaccaccacacctggctaattttgtatttttagtagagacggggtttcaccatgttggccaggttggtctcgaacccctgatctcagctgatctgcctgcctcagcttcttaaagtgccgggattacaggcatgagccactaagcccggccatatgcatttttaaaaaggatctcccctccgtgtactttagaaactttactttagggattctaaccttgggcaaacaataggtcacatatttgacacattctgccccttgcagaatagctttcactgaatttgcattgtaatgccaagacctttgctttcatcagtggctattcaacgtgttatcatatgggatgtaggaatgttcctggaaactttgtctattactcatttaatgaattctatattaacaccacatttataaagaaaatgtattaggaggtacctctaaggtagcaaaactctcctaataactttgtcttttatgataataatatctaagtaattgactatttttctcttcactttaactcccaggaaataccaaatttaaggtttggtgtatttgtaatctgcttacatcctgatctttactctttattttacatatttttgcctgatttttattgatatttaccagtattttatttgatatgtctttgttataagagatatttgtgtatatgtatctttgaacttgctgtatgccacataaggctccagatcatagaatgaagagtaaaaacagtatctggtctcatggagcttcaatcaaaagtgataaaaatgccaggaatcaggaaaagcttagtttctctttcaacaagtactctaagaaacaaacttctataatcctattgctttgggaggctgaagtgagaggatcacttgaggccaggagtttgaggctgcaatgaattataatcactacggcactacagcttgggcaacagagtaaggccttggctttggggggaaaaaaaggaaagaggcaaactactttggccttaagcatacaaagaaggtttgaatttcttaatttttttattcattcaacatttattaagttcctgctctgtgccaagaaatttgctagatattggtgattcagcagtgaacaaggcaaatatcacagctgtcgtggagttcacatcgtattcaggaaaagagacatggaacaaagaagaacaaatgtgatgttacagagatgccataaggactatggggaagaatgacagggacatttaacaagtctgggatacatggaagacctgtctccagaagagatatttaaacagggaactaagagataagtggcaaagggaggtaggaggtggagaaagagtgttctatgcagactgtttgggaaacactccactttctcttaagagggcaattgggaattatcctctcagaaccaaatcccccattttaccatctcattcttaatctctgcttctaccttgttttgaatttaagtttattattgttacagaatgttcttaatttcaaagttacataaagtattataaaatgctttttttagaaataaacttgccttttcacgtgtatcaggtgtctgatttctattttaactgatgtttgcccaattcaaagaagcttctttcattcttcattgaagaaaaccaaaataagtagaccgtggttcatacttttaaaatgtctacatatactttatggatcaatgaataggaatgcgaatacattcatcaaacaatttgcctgaaaacaaagcaaagctaaatatgaaaaactgaatagttaattctaactataattatccaacatacatatgctttttaattttttatactaacaaagaaacatgtgcaactaattacttatttgccacaatccaaagtcctcccacctaccatattcatgggctggattcttcctgttacccagctgaggcccaagcctgccaatatggggaccaagctggacttgatttgcagccaacaacagaaggggaggaattgtgagatttttatgggctctgtagctaacatctgactaagtgtatgtgtcttctacgttggtacctaaatgctacccacagcactcctatcattttattgcaaactatgattttataatagaaaaaaacactagaattgtggtcataaaacctgggtttgggccaggcatggtggctcatgcctataattccagtactttgagaggacaaaataggaggatcacttgatgccaggagttcaaaaccagcctggacaatatacagaggccccatctctagaaaaaataaatttaaaaaaatcagccaggtttgtggcacatatgtgatatctatagttctagatacttgggagatggaggtgggagggtcagttagttccaggagtttgaggttaaaaatgagctatggcctcaccactgcattctagactaggtgacagagcaagatcctgtctccccgctccgccagaaaaggacctcagtttaaatctccgaaaatctgtgtttcaatcctggggaactttacagctaagaaaacttgaagagctgtaggcaagtgcccaagggaggagtgtaatacacactttcacaggtgtattgcttgacaggactgccataacaaagtaccacatgctaggtgtcttaaacgacagaaatttatttcctcacagttttagaggctagaagtctaagatcaaggggcttagcctagcagggttagtttcttctgaggcctctctccttggcttagagattattgtccctctatgagtgtctttgtcttaatttcctctttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaatttcctctttttatatggacaccagttggattggataagacccacctcaatgatctcattttaacttaattacctctttaaagaccctatctgcaaatacagttacattctgaagtactgggtgatgagccttcaacacatgaattgtggagggatacaatttagcccataacaaaaggactgattgatagttttgtaacagcccaatgggttcttcttgtctgctgcccagaaaagcaggttttgcagcaaagaaagagtttaataattgcagggccagccaagcaaaagacatttatcaaatccacttccctgaaagctcaaagcctaggatttttaagaataatttggtaggcagggagctagacaacgggtctactgattggttggggatgaaattacaagtgtttaaaacagtctttgggacagtttctgggtgcgggtaacaggactggttgagttcattccttggcataagtcacaggtcgggtggagtcacttggttgccagaatgcaaaagtctgaaaaatatcttaaaaaccaatcttaggttttgaaaatcatgttgttatctataggagcaattggggaagttacaaatttgttgagtagtaagtgattatagaaaagcaagctagggaacaatggatagttatcgtttaaacctacatcttagcagaattcaggcccctcccataatcctcactttgtggcctttcattaatcttacacaggtggttttggactccacgcaagaagggggttaatttcaggaagggactgttattatctttgttttaaagttaataaaggcagttatcctgtgaggttagaagcaagatagagttaggtcagatttctcttaataattgttgcaagagcagtttcatttaaggatcagtttaaatgagacaagaaatgaagacacttgactttagttgatgtttttgtttgtttgttttgagacacagtcttgcactgtcaccaacactggagtgcaatggtgtgatctcagctcaatgcaacctctacctcccaggttcaagtgattctgctgcctcagcctcccaagtagctgggattacaggcacccaccaccacacccagttaatttttttttttttttttgtatttttagtagagacggggtttcactatgtttgccaggctggtctcgaactcctgacctcatgatcaggagtttaaacaacagaaatgtattatctcactgttctgtaggttggaagtccaagattcaggtgccaacgaattcagtttctggtgaaggctctgttcctggcttgcagacggctgccttctcactatgtcctcacattgcctttcctgagtgcatttgggtagagagagcaagacagcaagctatctggtgtctcttctgataaggacactaatcctattgaattagggccccacccttatgacctcatctcaccttcattacttccttataggccccattttaaaatacattactttgggggttagggcttcaacatatggattttgagggagacacaattcagttcatagcactaatgttttgggataaagaactagcagaggagtcgtgttataggaacaaagagatttattgcattttcaatatttctttaagcttactttatatttcgatctaagaggcaaagtttacttctttcaagacagtctttgtagagtaaatggtgtttcaaaggtcaggtttagggcaggtgcagtggttcaaacctgttatcccagcagtttgggaggcccaggcaggaggactgcttgagcctaggagttcaagaccgcctgagcaacatagggaggccccatttctacaaataatgtttaaaaattagctgggtgtggcagtgtgcacctgtggtctcagctactcaggaagaagcagaaggattgcctgagcctggaagatcaaggctgcagtgaaaaaacaaacaaacaaacaaaacaaaggtaggtttaactacaaattgatctatgttatatttagttaaaagggaaaaaggtatttttatatacagctctaacaattattttaaatcttaaatgattgttacatttcttcttaaatgactgctactgcaatagactattatcccagaaaaccatttgtgaaatacattattgttagcaatgtgctcatttccttgtcaacagaaatgtcattcttttttcttttaattttattgtgcttttttggggggttttttttgttttttgtttgttttctgacagagtctcactctcgaatgcagtggtgcgttctcggctcactgcaacctctgcctcccgggttcaacgggttcaaacgatgctcctgcctcaggctcccaagtagctggaactacaggcatgcaccaccacacttggctaatttttgtattttgtggtagagacagggtttcaccatgttggccaggctggtctcgaactcctgacctcaagtgattaacccacctcagcctctcaaagtgctgggattacaggcatgagccaccacacctggccagaagtgtcattcttttaaactgctcctaaagtcacatgattagaagttttggctcagaatcagaaataaaaatgtaacttttttctaatagtggatgatgatgataatgatagtggtggcaatgatgatgaaaataatagctcctacagatttattttattgacacatttttatctcctatataaactgttcattttggcaaatgtgccatattattcagagtgacctgtccagcacttacctgaaggttatggttataatttgttgtatagacagtgtgctctcaaaatcagctgtatcttttttgattactcacacgttcctgaatttcttataggcatgaggttaagagacaattataatgaatggagttttactggaaactttactattatgttaaattaataatcccacaattcctggtctattactcacatgaggatagctatcaaattatttacaatatgattgtgtattttgaaatataataactgtactgaacaaagacaatcatgttcctagaaaatggattgttaggcattttaaactgatgctcattagggacaatttacttgctgaatagcaatcattttttctttaagagaaaccaccttgggttttaatgtatacacccttaaaaccattatcaaagcataatttatataccctaaaatttactcatttcgagtataaattgtatgagttttagtaaatgtacagagttctgcaactaccaccagaataaagttttagaacactttaatcaccccccaacattcccttacgcccctttccagtcatcccccacccccagctgcaaggcaagcacttacctcctctctgttacacttttgcctttcacagaatttcaaattcatattttatatgtcttttgtgtctgatttcttttacttaccgtgatgtttttgagattcattcacatttttctgaatatcagtagtttcggctttatttgctgacctgtattctgctgaacgttacatgccacatgttgtttatacattcaccagttgatggctatttaagttgtttctgttgtttggttattataaataatgctgctaagaacatttgtgtacaatgccttgggtggacatattattttcatttctctgaagtaagcatctaagagtgtgtaattgctgggtcatgtggtagatatatgtttttgtgtttaagacactgccaaactgttttccagtggctacatcactttgcatttctaccagctatgtatcagagttccagttataccatctaatcactgacacttggcatttcaagtccttttaaggtagtctagaagatgtgtagtagtatctcattgtggttttaatttgcattccccaataaccaatgaggttgagcatctttttgttaagtgcctatacaaatcttttgcctgtttttaaaaattgagctgtttatattattactgagttatgaaagttcttaattagatctggatacaagtgctttgtcagataaatattttgcccatattttctcccaagctggagcttgtcttttcattttcttagcgattttaaacaagcaaaagattttaatttttctgaagttcatttattaattatttcatgaatggcttatgctttttgcgacttatcctaaggtcacaaaggtttttctcctatgcattgttctggaatacacacgtttttacccttacatttaggacaatgatccattttgaattaattttggtgtataatgtgaagaaagattcaaagtttatttcctttccatgtggatatccagttattccaacactacttctggaaaagaccattcttttcccatttaatttatctggcccctttaccaaaaatcaattgaccacataagtgtgaatttatttctggattctcagttctgttccattcatctatatgtctatctttatgaaacctttcatttttaatcctttggaagagggtaatatttagagaaaaatatatatgttcaatgctgtccactgaagcttatcatttatcaaaatttaaatatgataataggcaaacaaggacaattactggttctttaaaatgtatttttaccacacagtttaaaataaaatggtaattaaatcattttggatattttactgaatctagaaaaaactagaaaagaaaatcctattgtttaaggaaataagccactgctaataactgctgcattgattatattcatcatgaagaacaatttgcaaatttaagaggtatataaacattattatgagacaatgaaagcatagcaagaacacacctagtttctttaaactggttcaggtcttttcagccaccagtgaattacattcttgcgtataaaacataatactatgatgtaaccataagcatggtttgactgtcccctccaaaactcatgtggaatccccaactgacagtattgagaagtgggtcctgtaacaggtgattggatcatgagggctctacactaatgaatagattattccattcatggattaatggattaaagtgttatcatgggagagaaactggtgccttcatatgaacaagaagagagacctgagctagcactctcagcctctcgccatgtgattccctgcaccatctcacgactctgctgagtccccaccagtaagaaggctctcaccagatacatccccttagcctccataaccataataaatatattccttttctttataaattacccagtttcatgtattctgttataagcaacagaaaacgaactaatacaccatagaactatcatcagtaattttgagaagtggagaacacaagagttgccagaagactgaagatgcacagatgtttccattttcaaaacataaaaaatgaattccagaaactaaatgctaataagcatgatattgaaagctggcaaaattatagaacagatgaagcatatagtttatcaacatcttttcaagtcatcagtagaagataaaattgtttcttcatcaaactaaattacttaaattatatacctgaaaatggctaacaaaatgctgaattattgtaagtatccagtaaatatatttttaaaaaacaaaccaacctcaaacctgtctctggcaaattctgtaacaaagaaagaaaatgaagtcaaaaacagagaaaactacacaaaattatgttttaaatattatgcataattctacagttaaaaatagaaaattttggcctgggtgtggtggcttatgcctgtaatccctgcactttgggaggctgaggcaggcagatcacttgagcccaggagttccagaccaccctggccaacatgttaaatccagtctctactaaaaatacaaaacaaaatcagaaacaaaaacattagccaagtgtggtggtgcgtgcctgtagtcccagctactagggaggtaggagaattgcttgcatctgggagatcgcaccactgcactccagcgtgggtggcagagtgagaccctgtctcagaaaaaaagaaaacaagaaaaagaaaagaaaatcttggctgagcgcagtggctcacacctgaaatcccggcactttgggagggcaaggtgggcagatcacttgatgtcagaagtttgaaaccagcctgacccacatagtgaaacccccatatctactaaaaatacaaaaattagctggccatggtggcgggcacctgtaatcccagttacttgggaggctgaggcaggagaatcacttgaacccgggaggcagaggttacagtgagccgagatcatgtcactgcactccagcctgcgcagagcaagactccgtctcaaaatatattttaaaaaagaagaaaaaaagaaaagaaaatctagatgaaatggactcatctcaagttgtcaaaattgatagctccttctctgtatgtggcagcactggtgacacaaagtataaactagaaaatacccaagtggaagttaaatatatgaatttagagtccagggaagaagtcagggctggaatttgggaatagtcaatgcatttgtggtatttaaatccatcacatcagaaaagaccaccacggaagagaatatggacagaggagataagccaaggactgagtcctggaacaaccaggaatttattcattaaaagagaatgaggaagcagcactttgggaggccgaggcaggcagatcacctgaggtcaggagtttgagaccaacctggccaacatggcgaaaccccatctctactaaaaataaaacattagctgggcgtggtgccagcgcctgtagtcccagctgctcgggaggctgaggcaagagaatagcttgaaccctcgaggtagagattgcagtaagctgagatcgcgccactatactccagcctgggcgacagagcagtactctgtctgaaaaaaaaaaaagagagagagaatgaggaagtacagccagtgaggtgaggggaaagagacatgggataaagtagatcctgaaagctaaatgaagcaaatgtttgaaaaggaggaaatgattgactgcagcaaatgctgctgagtagtcaggtaagatgaggactgagaactgaagcaaagtggggattggacaagagcatattttgtccctaattgacaaaagcctaattggagttagttcaagatagaatgagaaaggataaaagagagacaaacagtactttgaagagttcttgtatagagaggagtaggaaaatattgctgaagctgaaagggaatgtaagttcaaggaaattttggttgttgttgttaggatgacaaattttataacacgttgtatgctgggaaaaataattccatagaaagagaaaaattgatgatgtagaagagaggaaacaatttcaggagaaatattcttgaatggtttagaggcatcacaagtggaatatctggtgtgagatgcagcctacacaactcgcccatgcaaggcagtgtatgtaggaccccatactgttagaccaatagatttaggaggtgttgcaggttagttttcccagaaggcagacactaagacagagtgaggagcctaaaatgtttactggggagtgactcctgtaaatggaaaaggcatgagtcagctggagccatcagacaacaatgtagacttctatgatgctgtcctaacagtctctgccggtccagctccaaagtcaagattgcctgttagaggagtcccaccttggatccttggatggaaatgaacagacccttgcacattgccttgctcagttgttggctgaaggccacaaaagaagcctatggcgtcagtttgaaagcagaagggaaccctgaagggattaattgctggaagctagcagctaagcacaatccttgcaaatagacaactagccttttattgaagggagagctgagtgggcacatcttcatgtctgacacagaataggaagatgtagaaattctcttttgtttactttcatcttcacagttgcattaggccattcttgcattgctataaagaaatacccgaggttgggtaatttataaagaaaagaggtttagttggttcctggttctgcaggctgtacaggaagcatagcaacgtctgcttctaaagagacttcaggaagcttacaatcaagacaaaaggtgaacagggagcaggcatgtcatatggtgaaagcaggagcaaggggtgcggtggtgtgccaaatacttttaaacaatcagatctcatgcactaatgcatggacagcaccaagtggatggtgctaaaccattcatgagaaaaccatctccatactccaatcacctcccatcaggccctgcctccaattttggggattacatttcagcatgacatttggacagggatacatatccaaactatatcaacagtgaagtaataagcaaagtcatcagcttgaatgagttgaggggagaaagagtgttggaggtttctagcaagaggagaaaacatgaagcagctgacttgaagactgcaagagtgaatacagagagattattaggcagccctgataatttatttagtagtgtttaaatttaaagcaatatcaacagaagaaagatcagcaaaagaagaaagaattatagaaagaactgaagaagacttttggtttttaaaatattgctagcaattagtcaacaaaaacagactacatgtaaggaagcaagaaccatgctggtctcgtattttattcaagaagcaacaaaacgtactcttaaaatataaaacataaaacatataaaagttgtgcatcagaagattcttagccctaagaaatagaaaacccaatataaatagtatagacaataaggcagatttattatttcacataagaatttctaatttggctctgagattggttaatttagtggctcaaagacctaggtttcttccatttttctgctttgccaggctcaggagatcagcttattctgagttactcatccccttgttcatgagtcggtcctacagttccaggcattacaagcagacatgacaatatcgagcagaataagaaagaagatctcactggctagagttgtgtcacatgcccattccaaagccaatcactattaacgggaaagcaattgatttaaagcacgtcggggtagagaagggtggactggccaaacaaaatcagaattttcttaataagaaaaaaggagaaatggctgctgggtaggcaatcaacagtacttctatgagaggaagaacatattgtaacttgtaaatttaaaaatccagcaaaactatcatttttttattgagggtacaatcctcagaaataaacatacttagaaaatataccacccatatatctttcttgaaaatattatagataactgagagaagaataagacaactcataaagaagtcatgttatgaaacaactgatagtgatcaacgaattcaataacacaagttaaatctgattgttttaattgtttttaagaagaatacctgcaaattacattaaaaactaaatacttaaatgacatttaagctaggatctgaaaattaaaaattatttagacaggtaaagagttgagagaagagcatgccagacagaaggaatgatgtgagcatttccttaaggctggagcggaaataagcataacatagattaggaaggtgtcagatcacaccgagccttgtgtgccatgttagggatttggaattttattttaagcagactgaacattgctagtgttttaagtatagtagtcacatatctcattctattttaagaagatcatactggtttctttctctttttttttaatcatgccacattatttttaattacatacaaagatctaacatgtcgcccagggaccatttcacccactgctctgtttggccgccagtcttttgtctctctcttcaacaatggtgaggtgggtaccctttcctcaggaaaaagaaattcacagtttgttgcccttgccaataacaaaaatgttggaaagacgagtggcaaacctgttgctgttggcatctttcatgtgaaccacgtcaaaagatccacggtgcctctctctgtggtgatcacaccaattcttcccaggttagcacttccagtcaccatacacaggttaccagtgtcaaacttggtgaaatcagtaatcttgccagtctccaaatcaatctgaatgatatcattcaccttgataaggggatcaggatagtggatggtgcgagcatcatgagtcacaagacgagagattccttttgtgcccacaaagatttttctcactttgcacaacttgtacttggcctcctcaggtgtaatatgatgtacagcaaagcgacccttggtgtcacagatcagatggaaattctctcccgtcttgtcaatgctgatgacatccatgaacccagcagggtaggttatatcagtttggaccttgccatcgatcttaatgaactgctgaatgcaaatcttctttacttcatctcctgtcagggcatacttaagtctgttccttaggaagatgatgagggagagacacactctcaacttgtgggaccggtggatggacgaggatcaaacacactggtcaacttatccagcatccaatgctttggagctgctacccacttcagatgcttcttgggatcacaagtcatggctgcattaagcaaggaaagaggacccccatcttccagtgtgtgtagaaatttggtttctctttaaaaagactgatgagagcaaggcaagggtggaagttaggaagctactgaaggtgagaaattatgttgttcatactgagcaggagtgtgaaaacgaaaagatattgataaattggaaatacatgtagagatatgcaataagacaagctgaaggattgcagatgtatgaggatgagttgagggaaatggtagaatcaaaagaagccaagcttttggctgtgtgggtggtagtgccacttactaaaaaggtaaggaccaaaagattaacaggttgcagctggggaaaggatatgggagaagggcaccaagaactctaatttgagttaatgtaagttaagatgaggtcattaggttggaccctaatccaatatgactcatgtccctataaaagggaaatctggacacagacagacagacagacagacacacacacacacacacacacacacacacacacacacacacacagagggagagagagagagccatgtgaagatacaggtagagatcagaattgtgctaccacaaactaaggaaggcctggggttaccagaacctgcaggcgttaaggaatgatcttctgctagaaaattcagagagagcatagcccagccaacatcttgatctcagacctatagcatccagaatactgaggcaatccatttattttgttttaagctaccaagtttatggtactttgttatagaagccctaggaaactaacacatcaggttaaattacacatggtcaaattataaaattatgataaatgtattatatggccaaatgatgaaatccatctccttccatatatcctgaattctcttgcctttatcttggataaataataaaacttcattccaagatggccaaataggaacagctccagtctacagctcccagcgcgagcgatgcagaagacgggtgatttctgcatttccagctgaggtaccaggttcatctcactgggggttgttggacagtgggtgaagcccacggagtgtgagctgaagcagggcggggcatcgtctcacccgggaagcacaaggggtcggggaattccctttcctagccaagggaagccatgacagacagtacctggaaaatcgggacactcccaccctaacactgtgcttttccaacggtcttagcaaatggcacaccaggagattatatcccgcatgcctggctcggagggtcccatgcccatggagcctcgctcactgctagcacagcagtctgagatcgaactgcaaggtggcagcgaggctgggggaggggcatccaccattgctgggtggagcccaccgcagctcaaggaggcctgcctgcctctgtagactccacctctggaggcagggcatagctgaacaaaaggcagcagaaacttctaaagacttaaatgtccctgtctgacagctttgaagagagtagtggttctcccagaatggagtttgagatctgagaacggacagactgcctcctcaagtgggtccctgacccctgagtagcctaactgcgagacacctcccagtaggggccgactgacacctcacacagccaggtgcccctctgagatgaagcttccagagaaaggatcaggcaggaacatttgccgttctgcaatatttgcggttctgcagcctctgctggtgatacccaggaaacagggtctggagtggacctccagcaaactccaacagacctgcagctgaggggcctgactgttagaaggaaaactaacaaacagaaaggacatccacaccaaaaccccatctgcacgtcaccatcatcaaagaccaaaggtagataaaaccacaatgatggggagaaaacagagcagaaaagctgaaaattctaaaaatcagagcaactcttctcctccaaaggaacgcagctcctcaccagcaacggaacaaagctggacggagaatgactttgacgagttgagagaagaaggcttcagacaatcagtaataacaaacttctctgagctaaaggaggatgttcgaacccatcgcaaagaagctaaaaaccttgaaaaaagattagacaaatggctaactagaataaacagcatagagaagatgttaaatgacctgatggagctgaaaaccatggcacgagaactacatgatgcatgcacaagcttcagtagccaattcgatcaagtggaagaaagggtatcagtgattgaagatcaaatgaatgaaatgaagcgagaagagaagtttagagaaaaaagattaaaaagaaacgaacaaagcctccaagaaatatgggactatgtgaaaagaccaaatctacatctgattggtgtacctgaaagtgacggggagaatggaaccaagttggaaaacactctgcaggatatcatccaggagaacttccccaacctagcaaggcaggccaacattcaaattcaggaaatactgagaatgccacaaagatactcctcgagaagagcaactccaagacacataattgtcagattcaccaaagttgaaatgaagtaaaaaatgttaatggcaaccagagagaaaggtcgggttacccacaaagggaagccaatcagactaacagcggatctctcggcagaaactctacaagccagaagagagtgggggccaatattcaacattcttaaagaaaagaattttcaacccagaatttcatatccagccaaactaagcttcataagtgaaagagaaataaaatcctttacagacaaacaaatgctgagagattttgccaccaccagacttcccttacaagagctcctgaaggaagcactaaacatggaagggaacaaccggtaccagccactgcaaaaacatgccaaattgtaaagaccaccaatgctgaaactgcagcaactaacgagcaaaataaccagctaacatcataatgacaggatcaaattcacacataacaatattaactttaaatgtgaatgggctaaatgctccaattaaaagacacagactggcaaactggataaagagtcaagagctatcagtgtgctgtattcaggagacccatctcacatgcagagacacacataggctcaaaataaagggatggaggaagatctaccaagcaaatggaaaacaaaaaaaaccaggggttgcagtcctagtctctgataaaacagactttaaaccaacaaagatcaaaagagacaaagaaggccattacataatggtaaagggatcaattcaacaagaagagctaactatcctaaatatatatgcacccaatacaggagcatccagattcataaagaaagtccttagagacctacgaagagacttagactcccacaataatgatgggagactttaacaccccactgtcaacattagacagatcaacaagacagaaagttaacaaggatatccaggaattgaactcagctctgcaccaagcagacctaatagacatctacagaactctccactccaaatcaacagaatatacatccttctcagcaccacattgcgcttattccaaaattggccacaaagttggaagtaaagcactcctcagcaaatgtaaaagaacagaaattataacaaattgtctctcagaccacagttcaatcaaactagaactcaggattaagaaactcactcaaaaccgctcaactacatggaaactgaacaacctgctcctgaatgactattgggtacataacaaaatgaaggcaggaataaagatgttctttgaatccaatgagaacaaagacacaacataccagaatctctgggacacatttaaagcagtgtgtagagggaaatttatagcactaaatgcccacaagagaaagcaggaaagatctaaaattgacacgctaacatcacaattaaaaaaactagagaagcaagagcaaacacattcaaaagctagcagaaggcaagaaataactaagatcagagtagaagtgaaggagatggagacacaaaaaacccttcaaaaaatcaatgaatccaggagctggtttttgaaaagatcaataaaattgatagaccgctagcaagactaataagaaaagagaagaatcaaatagatgcaataaaaaatgataaaggggatatcaccactgattccacagaaatacaaactaccatcagagaatactataaacaccctatgcaaatcaactagaaaatctagaagaaatggataaattcctggacacatacaccctcccaagactaaaccaggaagaagttgaatccctgaatagaccaataacaggctctgaaattgaagcaataattaatagcttaccaaccaaaaaaagtccaggaccagacggattcacagctgaattctaccagaggtacaaagaggagctggtaccattccttctgaaactattccaatcaatagaaaaagagggaatcctccctaactcattttatgaggccagcatcaccctgataccaaagctaggcagagacacaacaaaaaaagagaattttaaaccaatatccctgatgaacatcgatgcagaaatcctcaataaaatactggcaaaccaaatccagcagcacatcaaaaagcttatccaccatgttcaagttggcttcatccctgggatgcaaggctggttcaacatacgcaaatcaataaacgtaatccatcatataaacagaaccaaagacaaaaaccacatgattatctcaatagatgcagaaaaggcctcaacaaaattaaacagcccttcatgctaaaaactctcaataaactaggtattgatgggatgtatgtcaaaataataagacctatttatgacaaacttatagccaatatcatactgaatgggcaaaaactggaagcattcactttgaaaactgccacaagacagggatgccctctctcaccactcctattcaacaaagtgttggaagttctggccagggcaatcaggcaggagaaagaaataaagggtattcaattaggaaatgggaagtcaaattgtccctgtttgcagatgacatgattgtatatttagaaaaccccattgtcgcagcccaaaatatccttaagctgataagcagcttcagcaaagtctcaggatacgaaatcaatgtgcaaaaatcacaagcattcttatacaccattaacgacaaacagagagccaaatcatgagtgaactcccattcacaattgcttcaaagagaataaaatacctaggaatccaacttacaagggatgtgaaggacctcttcaaggagaactacaaaccactgctcaatgtaataaaagaagacacaaacaaatagaagaacattccatgctcatgcataggaagaatcaatattgtgaaaatggccatactgcccaaggtaatttataaattcaatgccatccccatcaagctaccaatgactttattcatagaattggaaaaaactactttaaagttcatatggaaccaaaaaagagcccacattgccaagacaatcctaagccaaaagaacaaagctggaggcatcatgctacccgacttcaagctatactacaaggctacagtaaccaaaacagcatggtactggtaccaaaacagagatatagaccaatggaacagaacagagccctcagaaataacaccacacatctacaaccatctgatctttgacaaacgtgacaaaaacaagaaatggggaaaggattccctatttaacaaatggtgctgggaaaactggctagccataagtagaaagctgaaactggatcccttccttacactgtatacagaaattaattcaagatggattaaagacttacatgttagacctaaaaccacaaaaaccctagaagaaaacctaggcaataccatccaggacataggcatgggcaaggacttcatgactaaaacaccaaaagcaatggcaacaaaagccaaaatagacaaatgggatctaattgaactaaagagcttctgtgcagcaaaagaaactaccatcagagtgaacaggcaacctacagaatgggagaaaaattttacaacctacccatctgacaaaggattaatatccagaatctacaaagaacttaaacaaatttacaagaaaaatcaaacaaccccatcaaaaagtgggcaaaggatatgaacagacacttctcaaaagaagacattttatgcagccaacagacacatgaagaaaatgctcattatcactggccatcagagaaatgcaaatcaaaaccacaatgagataccatctcaacccagttagaatggcgatcattaaagagtcagaaaacaacaggtgctggagaggatgtggagaaacaggaacacttttacactgttggtgggactgtgactagttcaaccattgcggaaaacagtgtggcaattcctcaaggatctagaactagaaataccatttgaccagccaccccattactgggtatatacccaaaggattataaatcatgtggctataaggacacatgcacatgtatgtttactgcggcactatttacaatagcaaatgtccatcaatgatagactggattaagaaaatgtggcacatatacaccatggaatactatgcagccataaaaaaggattagttcatgtcctttgtagggatgtggatgaagctggaaaccatcattctgaacaaactatcgcaaggacagacaaccaaacactgcgtgttctcactcataggtgggaactgaacaataagaacacttggacacagggaacatcacacaccagggcctgtcgtggggtgaggggaggggggagggatagcattaggagatatacctaatgtaaatgacgagttaatgggtgcagcacaccaacatggcacatgaatatctatgtaacaaacctgcacgttgtgcacatgtaccctagaacttaaagtataattaaaaacaaacaaacaaacaaaaaaactcattaaatccagttttcagacctctccatgactatacctgcacagtgaaacctgtacagagcaaaacacaaaactatgttgattggtgtcacttacaacacatgatttttttttttttttttttttgagacagagtcttgccctgtcaccctggctggagtgcaatggcgcaatctcagatcactgcaacctctgtctcctgggtttaagcaattctctttcctcagcctcctgagtagctgggattacaggcacatgccaccacgctcagctaatttttttgtatttttagtaaagacaggtttcaccatgttgcccaggctggtctcaaactcctgggctcaagtgattcaccaccttggctgcccaaagtgctgggattataggcatgagccaccacgcctggccaaaactatttcatatcttctctctctgaaaacctccaatacctctttcctaatcttcaatcctagctaatgacctcactacctatttcaacgagaaaacacaaaacctcataaaaatatttacaaaggttcccatgaccacataagcctacctatctgcatttgtccccatattctctgccaaccagcctttccacttttggactatatacaatcccctcttgcctactcaaggacattgctccaaaaatgtatcttttcccctccatcataaaagtatacctctctactagatcattctcattcgctactatttcttactcattaaaaaaataaaataaaataacaaaccaacattcttttgatcccactttcagtcacaaccctatctctttcctttctttcccaaaatgacatttactcatttgacatgacagttccagtttatgcttcattattaattaattaaatcatcattcaattattaatggtggccttttcaaatgtgttttagtttggattgtaaatatatggatagcttatcttttaatatagaactcattctctcccatttctcaccttgttttctctcttgagccccactgcaaacaggtcttcccccaatattccattgaaactgctgttttcaaggtcatcaaccatgtccacgttgttaaatctaattgtcaattctcattcctcacctttttgacctttcaatatcatttgacatagccaatcattccttccatctttaaataacttttttgcttggttttaaaggcaccatactctcctgattctccttttgttactcaggagaaaccgtatctttgctctagctggtaggaggaaagaaataataagtaaaaatgggtccctccctttaaggaaacttcccagaagcagtacatacctcttctgcttggtcatatggccacccttagctgcaaaagagtcttggaattgcattttatacatatatttttaaaaatacaaatttatttatacacacatatatatgttatacataaattgtatttatatatacatatatgtaatatatatatatatatatacacacacacgtacctatacatgtgatatatatatatgtatatatacacacatacatatttttcccctgggcaatcagataatcatgggagattctattatgggagaaggggagaaagaatatttgaaaacaactagcacagtaattttcaagttttctacaagatttgaaaaataatattagacaacaattttactggacaagtgcggtggctcatgcctgtaataccagcactttgggaggccaaggcgggcagatcacgtgaggtcaggagttcaagaccagcctggctaacatggtgaaccctcatctctactaaagatacagaaatcatcctggcgtggtggcgcgcacctgtaatcccagctactcaggaggctgaggcaagagaattgcttgaactggggaggcagaggttgcagtgagctgagattacaccactgcactccagtctggatgacacagaaagactctgtctcaaaaaaaaaagaaagaaaagaaaagaaaacaattttactttaaaaatataattgaataatagtaaaaggagatgagaaagttaaagaataacaaaaatgcttaagtctaaaattattatacaggtttctcttgggctcttttcttcagtgaaatttagaagtattaaatgtgtatgaagtgtattgggtcatatttttagtaaatgtgatatagttagtagctataacactgtatatataaagagcttataaaccgaaaagtatccgagacaggtttcaatcaatttagaagtttattttgccaaggttaaggacatgcacccaggagacaggtctgtgtatctctcaaaagatgattttcagggcttcaatatttaaaggggaaaagcaggctggaggggaaggagggagggtatggttacactactgaatccacatgtagcaagagaaaaggggcaggtagggaaatagtcaattatgtattcatctcaggctcggtaaatcaggattttacataagataaggtgaacatagagtagccacctgtggagataatttaactttttatctgtagctgtctgcttaggaacagaaggaaaggcagcttcttgcactactcagttttcagcttattttttccttttggtatagtgaatcaaggtcctgagtttttattttcctttcacaacctcataaaattgagaggcatcacgccaaggtcccaatacataaattggcaaagagcaaaaacaaataatatataaactatagcacacttaattaaatatcatctttatccttcctggtaatcataagaagtaaattaagagagcaagatatagagttatctatcaattttaccataaaaaagtatttatttgctttgctattaattctgatattcaccactggtaagtgtgcttctgagaatatacattttgtcaacacttagaaaagcaatttttaccttaggaaattaatgtccttggtatctacttttgggaatgcagttaatctagttttgggaatctatcctacaaaaataatccaacatgtagacaatcttttggcacaaagatgttcattacagagttatttccaatagagaaacattgggaaaaccccaaatgatgaataatagagcaactgataataaatgttagtctatctattcaatgaaatatcatgctataattaaaattatatttataaggaactcataatcacaaggggaaatgttcatgatatattattaaggagaaaaattatttcatgattacataaatataaatgccaagcaattgtataattagcaaataaaagaatgacgagtaacattaaccaaaaaaatactgataaaatatatttaaaagctattttagaattaaatagacaatccaagtgattgcactaaaaaacaccctgaacccaaaataaaaccaaaagtacaaggaggttgtattaggcaaaataatggtcccaaagatgtttatcttcctccccaaaacctgtgcatgttctgttacatggcaaaagggaaattttgcagacacaattaaggctgcagactttatgagagggagattatcttggatgatccaagtgatcccaagggctaattacctaagggctaatcataggagtccttaaaagcagaggacattctccaggtggcagcaaaagagatgagacagaatggggaggtcagaagaacttgaaatgtgagaaggactagactcattatttctgactctgacaatggaggatgggggttcagagctaaggaatgtgatagcctctggaagctgagaatgactccctctcagctgagaaccacggctagccaaggacatggaacctctgttctaaaactacaagaaactaatctgggtctgaaacctgaatgagtttggaagcagagctaccctagggcctccagaaaggagtgcagccctgctgacaccttgatttcagccttgtgtgactaagaagtggacccacctgggccacgctataccaggacctccaactcgaactgtgaaataataaagttgtggtaatttattatggcagcaatagaaaactaatacacagagctgggcaaggtggcgcaggcttgtagtctcagctacaccccaccagaggctgaagcagaaggagtgattgggcccaggcattcgaggctgcagtgagccattaccgtaccacggcactccagcctggagacatgagacctgtctctaaaataagtaactaaataatttatttaaaaattatttaggccaggtgcagtggctcacgcctataatcccagcactttgggaggccgaggcgggcggatcacgaggtcaggagattgagacaatcctggctaacacagtgaaaccccgtctctattaaaaaatacaaaaacttagccaggtgtggtggcaggcacctgtagtcccagctactcaggaggctgaggcagaagaacggcgtgaactcgggaggcagagcttgcagtgagccgagattgcgccactgcactccagcctgggtgacagagtgagactccatctcaaaaaataaataaataaataaataaaaattatttaaatgttttacaaaaatagaaaatacagagggtaaaaattagaaggtcaatttaacaacaaatgcctctgtgatctgtaagtggaaaggaatatctagctttcacagatatttgatcatagagacatcatatgcataccctggaagaacacttaatagtatcagagttatcaccaaagaagggctggaaaaggacaaaataatattgtcaagggcaccaaacctctctctgttatataatgatatgataatcaaagaaactgtatggctatccaagaaagtcttcttgggaagctagggggaattaagagaggtaactaagaaaagggtgattacatataaaggataatgattgttgaaaaaatggtggataggaggcagcactaactagcagctccctcttgaatggacagagcagcatatggagacctacatcatggccttttgctaacgcagaaatatgccaggaaagcagggagaatccacagactctttgaaggaagcggcttgccactgcaggctccgtaagacagctgaaaaactgtgagcgctcatagtgtgagagggggaacatcgcccctgaaacacgcatcctcactgggtaacctgaaggtccagatcacaggaggatttgaccttacctgaagctgagacaaatttagagaggtgagcgaaatataggggaccaaatacatggaaccaaaaaagagcccacatagccaaagcaaaactaagcaaaaagaacaaatatggaggcatcacattacccaacttcaaactatactacaaggctatagttaccaaaacagtatggtactggtataaaaagaggcacgtagatcaatagaacagaagagagagcccagaaataaagcgaaatagtgacagccaactcatcttcgacaaggcaaacaaaaacataaagtggagaaaggacaccctattcaacaaatggtgctgggataattggcaagccacatgtagaagaataaaactggatcctcatctgtctgaccttatacaaaaatcaactgaagatggatcaaagacttaaatctaacacctgaaaccataaaaattctagatgggaacattggaaaaacccttctagacattggcttaggcaaagacttcatgaccaagaacccaaaagcaaatgcaacaagatatacagtgcaacaaacatatgaaaaaatgctcaatatcattaatgatcagagaaatgcaaatcaaaaccacaatatgacaccaccttactcccacaagaatggccataatcaaaaaataatagatgttgatgtggatgtggtgagaagggacacttttacactgctggtgggaatgtaaactagtacaaccactatggaaaacagtgtgatttcttaaagaactaaaagtagatctgtttgatccagtgatcccactactgggtatctacccagagggaaagatgtcattatatgaaaaagatacttgcagccaggcgttgtggctcatgcctgtaatcccaacactttgaggggtcgaggtgggtagatcacctgaggtcaggagtttgagaccagcctggccaacatggcaaaccctgtctctactaaaaatacaaaaaattaactgggcgtggtggcaggcacctgtaatcccagctacttgggaggctgaggcaggagaatcacttgaacccaggaggcagaggtcacagtgagctgagactgcaccattgcactccagctagggcaacgagaatgaaactccatctcaaaaaaaaaaaagatacttgcacacgcatgtttatagcaccacaatttgcaactgcaaaaatatggaatcagcccaaatgcccattaatcaatgagtggataaagaaaatatggtatgtatatatcagggaatactacttagccataaaaggaacaaaatggcatttgcagcaacctagatggaactggagaccattattctaagtgcaataactcaggaatagaaaaccaaacattgtatgttctcattctcataagtgggagctaggttatgaggacacaaaggcataagaatggactttggggccaggtgcagtggctcacgcctgtaatcctaagcactttgggtggccggggcgggcagatcacctgaggttgggagtttgagaccagcctaaccaacatggagaaaccccatctctactaaaaatgcaaaattagccaggcattgtggcgcatgcctgtaatccaagctacttgggaggctgaggcaagagaatcaatcgcttgaattcgggaggcggaggttgcagtgagccgagattgtgccattgcactccagcctgggcaacaagagctaaactctgtctcacacgcacacacaaaaaagaatggactttgggaacttggggggaatggatgggaggggagtgaaggacaaaagatgacacattaggtacagtgtacactgctcaggtgatgggtgcaccaaaatctcagaaatccatgaaagaacttatccatgtaaccaaatactacctgtttcccaaaaacctattgaaaagaaaaataataaaggaagaaccaacctgtgggcttaggtatgtggggtgtagctttgcctgctaactccggttaagtcaatatggttaataaaatcatttaattacagatccacagatcacttctttcctgggtcaggctctctacatggaagatgggctgcgaagagatggaagttcactttccttgtgctgggggtaagttaccctgggactggaataatactggcagtctaggtttagatcagaggttggctgacaatggcccactgcctatttttgtaaataaagtttatagaatatagccatgcccattcatttacatattgtctgtggctaacttcattctataatagcagagttaagtagctgcaacagagaccatatgattcacaaaatacttaattttgtcctttatacagaaaaaaatttgctgactcctggcccaatatatattgaacctaaacacaatgaagtaaacagaaatacttatattaaggtggaaaaaaattacctgcaaatatacagaataggagagacctgactcggcaagaaatgtgcttgaatgaaaaaatcttgatggttacaaatcagcacaaattatataaggaaggaaaaagtgcttaaaaaaaaagaaaacatacgcttagactaccctaaaagaaacaatatctggaccagtagttacagttctcctgtatgaaccattcttcaatatatactcttgtctccaaactgttctctgcctagcaccttctaaccagtggttaatttacacttatctgtcagacttcagcttagatatcatttcctctgaaaagccttctttgattccccaaaactgggttccatgtacttacttactttatcatggcatttaacatatcatactgaaattacttctttatttgtccatctgccccactagatgaatcctgtaagcagagataggtagatggtattccaataccaggcccagtgcctgccacataacagttttttaacatgttcattaaatgaatgccacagccccattatattccttatcagttagactgcatagtataagtatagtcatgtgtcacttaacaatggggatacattctgagaaatgtgtcattaggtgactttgtcattgtgtgaacatcgtagagtatatttacacaaacctagatggtgtagcctaccacacacctgggctatatggtatagccctattgctcctaggctacaaacctgtagaacatgttactctggtgaataatgtagtcattgcaacacaatggtaagtatttgtgtatctaaacatgcaaaaaatatagtcaaaatacagtataaaagataaaaaaaaatagtatgcctgtatagggcacttaccgtggatggagcatgcagaactggaagttgctctgggtgagtcagtgagtggtgagtgaatgtgaaggcctaggatgttattgcacaccactgtagacttcataaacattgtacacttaggctacactaaatttataaaaaaacctttctttcttcaataataaattaacctcagcttactatacttctttacttagcttactgtaacttttttactttataaacttaactctttatacctttttaactcttataataacacttggtttagaacacaaacattatacaactatacaaggatattttctttccttaggtcctttttctagattttttttctatttttaaaaattgtttaaactgtaaacttttgaaacaaagacactaacacatgtattagccttggcatacacaaaatcaggatcatcaatatcactgtcttccacctctacatcttgtcctactggaaggtcttcaggggcaatatcatggagctgtcatctccaatgacaacaatgccttcttcaggaatacctcctgaaggacctgcctgaggctgcttacagttgaattttttgtttaggccaggcacagtagctcacatctgtaatcccagcactttgggaggctgagacagttggttgcttgagcccaggagtccaagaccagcctgggcaacatggtgaaaccccgtctcttcaaaaagtacaaaaattagctgggcatggtggcagatacctgtagttccagctacttgggaggctgaggtgggaggatcacttgagcccaggaagtcaaggttacagtgaaccgtgataatggcaactgcactctggtctggggcaaacagggtgagcccctgtctcaaaaaaaaaaaaattgtttaataagtagtacattctaaaataacagtagcataataaatacataagccagtaatcaagtttaaatcaaatgtttatcaagtactatgtacataattgtactatactttttttcctccagagcaggaatggaagtttatttaaaaaggctttagaacaggaaagaaaggaaagtatgcttggaagaaatctaaacaggacatgctatacttttatactactggcagcacaataggttaacaccagcatcaacataaacacatgagtaatgcattgtgctatgatgttaagatagctaggatgtcactatgcgataggaatttttcagttccattataatcttatgggaccaccttcctataatgagtctgttgttgaccaaaatgtcattatgcaggacctgttttcagttttggtaattggcagactgaattccctgctcaaatctatccccttccctaccctctggtagacagatccctagttttaactgggttctttcctctgtggccacgtactcggaagaatcagtactccagtccttagggtgattaatcttttctttttttttgagatgcagtttcgctcttgttgcccaggctggagagcaatggtgcgatctaggctcactgcaaaattcgcctccgaggttcaagcgattcccctgcctcagactcccaagtagctgtgattacaagcatgcaccaccacaaccggctaattttgtatttttagtagagacggggtttctccatgttgctcaggctgatctcgaactcccaacctcaggtgatccacccacctttgcctcccaatgtgatgggattacaggtgtgagccaccacgcccagcccagggtgatttatcttaaccagatggttcaggagggaatgtgatgcatttaggtacagtgacatgtaaagggaagtcaactgagccattactggaaaggagagatttacttaaaaagaaaagtgtgaggaaaatgagttttttctgcctttgaatgtgcctatgtttaaagaggttttgctagaagctgcttgcaaccatgaacatgaggataaaaatcccctgcattgaggatggcagagatgaaagacagaaagagctagggtccgtcatcatcagtaagcatctggaaccaccccatcgccagatgtttccttatgtgaatagggtaacacttttagttggcttttcctttacttgtagacagaagcatgctaacttatgcaagtgaccacattttaagcggaactttagcaaattggggcacatctaaatggcaaataatggtgaaggctttggaaaccatgtcttttgaggaataaaggattatggatgtaaagtctagaaaaaagaagacttggcatgagatataacagctcttctgtaatgtgaatgaaaaacctaggaccaagtgtggtaatggggagctacattaattcacaaataggagaaaaaaggtcaaactagaactacttaaaacagaaaggtttatggggtagtatgttttcttgttaagaacttcagctgtaatttggtgactccctgttgtgagcattctggatttgctttggtgtgaggctgagcaacagaacttctgtttccttccaacccttaagatgccataattttatctgacttcgtgacatgtactgcaataattgtacaagcagggaggaagagtacagttcacccttgcacaacattggcttgaactgcacaagttcactcacacgcaatttttttttcaattaatacagtcagccatgcatatccacgagttccatatccacaaccaaatgaagatatgaaatctgttgatccaaagaaccaactccctgacttaaagatgcttggattttggtatccaaggggaccctagaacaaatctcccatggacatggagggatgattggaagtataaaattgccagtgtatatattattcatgcttcaatctctaaaattggtggcactataatagcctctggacatatttatggaactaccccagaaaatcaaaattgaaggatactcagtaaagagtactaacaagaaactcaattgttcctgaaggcaaaaaaagaaaaaaaggagggggtagaagtattgatacacataaaaattgcaaagtgttaactgcgcccccaataagatttacagaaaaggattacatatatgaatatagtaattctcaaatatctttgctaggaaaaacttaacatttaaaataaagatatacttagccttagcatgtttttagatattataatacaggaatgttttaaattctggatatttatagaaataggatattaaaaagttgcttaatttactcattctatatccctcttcaaatctcttccatcttcgtagttccaaagtcttgattgaaaaatctcttgttcaactgcaagaaatggagtaaaaataaactggtggaaaaaagcaacaaatatggctaccatagctatgccaattatgataataaattataaagtaactatactgaattcaaataaacactaaattgccccaacattattggtataatgatagcagtgagagtccagactcacttttcatgtcaaattggaaccataagattccaatagatatacccttgtgggtatatcatttaatgaaaaattaaattgcatatgccattttttttacattaaattgaagaatttctgtatgtgccaatttatttgctttagggttttttgttgttgttgttgttgttactgttgttttccagagacagggtctcactgttgcccaggctggagtgcagtggcacaatcatagctcactgcagccttgaatacctgggctcaagcgatccttctacctcagcctcctgagtaggtaggactgcaggcctgtgccaccatgcccagctaattttttaaatttttagtaaagacaaggtctatgttgcccaggctgggtgcaaactcctgggctcaagcaatcctcctgtctcagccttccaaagcgctggaattttgggtgtgagccaccacaaccaacatgctttaggttttaattcaaatgatgcacatgccaagtgaattattatagatctttcacaagtgtttaattattggaattttgttcaacatatttccttatacttgacttgttcagtaatttcaaaatcccctgctctgattatactgtgtatctattttagttggagtgtttttgttttgttgttttttgagatggaatcctgctgtcgcccaggctggagtgcagtggcatgatcttggctcactgcaacctccacctcccaggttcaagtgattctcctgcctcagcctcctgagtagctgggattacaggtccctcaccaccacattcagctaattttttctatttttagtagagagagggtttcaccatgttgaccaggcaggtctcaaactcctgacctcaggagatccgcctgcctcagcctcccaaagtgctgggattataggcatgagccaccgagcccgggcttggagtgattttaaatattatgaaggatggactttcatcatacccctatacatttattttacccatatccttcagtgatacttttttttttttttgagacaacttctcactctgtcacctaggctagagtgcagtggcatgatctcagctcactgcaacctctgcctcccaggttcaagcaattctcgtgcttcagcctcccaagtagctgggattacaggtgtgtgccaccacgcccagctcatttttttgtatttttagtagagacagggtttcaccatgttgaccaggctggtctcacactcctcacctcaaatgatccacctgcctcgacttcccaaagtgctgtgattacaggtgtgagccaccgtgccggcctagacacttctgattttttttttcttttttttttttgagacagagtctcgctgtgtcgcccaggctggagtgcagtggtgcgaccttggctcactgcagcctctgcctcccaggttcaagcaattctcctgcctcaacctcccaagtagcggggactacagatgagcaccaccatgaccggctaatttttgtatttttagtagagacggggtttcaccatgttggccaggctggtcatgaactcctgacctcaagtgatccacccgcctcagcctcccaaagtgctgggattacaggtgtgaacaaccatgcctggccatctttttcttaaacatttatttgcatgtctatttttcttcaaaaaaattatcattcttgatgacattttgagtatttgagttcttgtcatataaatcaaaatgcttctgctgaatggttgcaagaaaggttcatcacttcgctatatactttcctatccttcataatgctcaagtattcctaaacacaatgaagaattaatatgagaaattcaggtaaactgggtcaataaattaaccaataaattttaaaataatacaagaaatttcacttaccattcaaatagtatagtttgtaaataacaaatttttttgttaatgacagcatgttgaaaataaaaactaacttataagttatataatattacctttctgtctaaatgatttcagaattaaaaaaaaacccagattactatttttattaagtgatgtgttttttctgggaccaaaaatttattgtgcataatttataatactatatatatagcaggaaaaacattgagtttgtattttttaatatgcttccctaaaaggtttcaaattctcaaacctgctaagattgtaacaatactgttgacaacatatatgctaaatttcagtattttaacattcacatgaatttctttaaaatttacaattattgtctaacatctaatggtttataaaaaatcatcatgcttacattgtttcacgctttcattttttacatctcaaaaaatcgatcttaagaacccaaaaattaaaaatgtattaagtggctgggagtggtggctcacgcctgtaatcctagtactttgggaggctgaggcaggcggatcacctgaggtcagaagttcaaaaccagcctggccaacatggtgaaaccctctcgcctaaaaatacaaaaaaaaaatgagctgggtgtggtggcgtgcacctgtagtcccagctacttgggaggctgaggcaggagaactgcttgaacctgggaggcaaaggttgcagtgagccgagactgtgccattgtactccagcctgggtgacagagcaagactccacctaacaaacaaaaaaaaaagtatcaagtattggctgggcatggtggcttatgcctgaaatcccaccattttgggaggcaggggttcaagaccagcttgggcaacagagtgagactccatctctacaaagaaaaaaaaaaatagctgggtgtggtggcacacacctgtaggcccagctacatgggacgctgacgggggaggattgcttgagctggaagctggaagctacagtgagttatgattgtgccactacactccagcctgggtgacagagcaagatcctgtctcaaaaaaaaaaaaaatcaagtattataatttaatgaaatttgcattttaaaaacactactgcttctacatactgtgtatctctaccttttggtatttatatattctaaaaggaaaattgaaacaaaatttactttctatagcacttcaaagtacagactaaaaggagattgtttggaccgtaaggaattaggcacagctgaaattaattctgagtattagtcaatttcccaaggagaaactacttcacccactactcttttggacttacttccatctgtttagctgagaatattggcagatcgcaacagccacatcatatgttacaatcaaagccagatgacattctggcattgtagtaccattaagtgatatgctaattttgttttgtgataaatcaactgtaagttcacatattcaaaatccagaagcccacagtatggcaaatattcccattccaccctcccatctttttttctcctttggattcaagaagtttgccccccttttaataactaccagcaactagttttctgtgtttcatctcccttcaatcaaactgaaaggaagaatttgatatctgaaaaacatccttgatacctcatccattcattttattctttcaataaagttaattgagcacctactatgtgccaggcactgtatgaggcataaaaaatacaaagttgaacaatgacaatgacagaaacaaaattccggtcctcatggagtttacaatctagtggttctgacattaatcaaaccaatacatacaaaattacacgtgttaaatgctaagtagaggtacatggtcaggtgagacgtataacaacgggtcttactctgtgacagaaattagggaatgtttccctgaggaagtgatgaactagctaagatctgaaagacaaataggaattaattaggcaattgggaagggatagatatttcaggccaaagaaacagcatgaacaaaagtcttatgctgaatgaagcactgtaattctcattccgaatacttaaaggacaatgaaggtattaagtaaaacatggtacatatgaggctaagtggcaacaagaataggtaacctctattgaggtgatgtgccagccactgttttaatctgagacagtaactattttaatgcttggaactatgctttagatagtggccctaatatatctgacctcataggtcaaatatatttggtcacataaaatatttccttttcatcattaaggacaataaaaagccattcgagcattttaagctaggggtgcaagtgcaggtaggtgggttgtcttgattaaaattgaacttcgaacaaaaaggagaattctgcttgcagtcgagtgaatacagggagggccagagtcgctgcaggaagaacagttaggagacaactgcagtcatgcaggcaaaaggtgctgatggtagcttagattagggtgtggtgagaagtagacacatttaagagatgtttacaaggtaaaaatgacaggacttgatgacaaagtgataggaagatatgtcaagattatttctatgttaccagtttgggaaccagggtgaatggtggtggcattcactgggataagatgccttggttagactgtaggttaacacaaacttattaaaaagggggtataactcccctactgacatgtattgaataaaaacccacaaaagaattcctggtgagtttcttccacatatatttgcctttggtcatacacagtcattcttatatgacttaactaaaaataatgcttcatcacaactagtatatatgggggcatttccaagttcttttttttttttttttttgagatggagtctgtgttgctcaggttagagtgcagtggtgcaatcgtggctcactgcagccttggcctcctgggttcaagcgattctcgtgcctcagcctactgattggctgggactacaggcgtgcaccaccacgcctggctaatttttgtatttttagtagaaatggggtttcaccatgttggccaggctggtctcgaactcctgacctcaagtgatctgcccaatttggcctcccaaagtgctgagattacagggatgagccaccgcgcccagcctcaagttctaggataaggtgagaaaagaaaaacattcaaaatacccaatgttttttacatacatgaaattaaaaagcacagcacagaaaacccactacaaagctactgtaatcatacccgttagaatgactattatcaagaagacaaaagggaagtgttggagaggatgcagagaaaaggaaagaaaagctttgtacactgttggtggcaatgtaaattattatagccattatggaaaacagtatggagggtcctcaaaacattaaaaaatagaactaccatattatccaccaatcccactatttggtatatgttcaaaggaaacgaaatcagtatgtggaagagatatctgcaatcccatgttcactgcagcattactcaatagccaagatatggaatcaatttaactgtccatcaatggatgaatggaaaaagcaaatgtggaaaatatacataagagaataccattcaacttttaaaaaaaggaaatcctgtcatttctgacaacatggataaacctgggtgtagtggcacacgcctgtggtcccagctacacaggggaccactgtgttaagtgaaataagccaggcacagaaagacatgccaaaattctagatgatctcacttacggagtgcaaaaaaagtcaacttcatgggatggagagtaaaattctggttatcagaggctgggggatggggaaatggggagatgtttgtaaaaggacacgaaattgcagttagtaaatataagttcaagagatctactgtatatcacgtgattacagttaataacaatatgctgtatacttgaaaattgttacaaaattttaagtgttctcgctacaaaaaaagtttgtgaggtaacatgttagacagcttgatttagccattccacaaggtatacatgtatcacatcgtgttgtacaccataaatatataatttttacttctcaattaaaaatataggaaaaaaactccaaaaaactcaaaagtaaacaaaaaataaaaataaaaagcaaagcacaattgtcattttcaactcctgaccattaacatctctcagctagagatttcttttttaaattccaggacatgacaactttatatctaaattatggtaacttaaaaaaaaaaagccaactctggtaagtcaattatcaggctttcctgtatttctcagactgctagtttgggattcacttaaacaaaaatcatcctatcttttaggtagtttgaataacacaaacagggtaacatatacctcatacatagacgtacacacacaatttaaagttttatggtcacctttaaaagataaaaaagataagggaaaatgtgtgaattaatgactaagctataataaaagcatataactaggctttaagtctaaagaccagattactaattgtgatttcagtcatttgtcctttctaagcctcagggcatttttttaaaaaaaatttctaacatttgaataatacctacctctcagaatacagtgttttatgaattttaaacatctataaaaatagtactgcttataaataaaaaaatcaaactaagcacacagaatgctcagattatcataatctctaccgtttgtatgatttccttgggaagaccaaataaatttaaaagtagtaagtaaaacattcagcttctataacaataagcaattataatatacgatagaggccgggtacggtggctcacgcctgtaatcccagcactttgggaggccgaggtgggcggatcacctggggttaggagttgaagaccagcctggccaacatggtgaaaccctgtgtctactaaaaataccaaaaattagctgggcgtagtggtgggcgcttgtaaccccagttactcaggaggctgagacaggagaatcatttgaacccacgaggcggaggttgcggtgagctaagatcacaccattgtactccagcctgggcaacaagagcgaaacctcatcgcaaaaaaaaaaagaaaaacatagaaaaatttaaatttatatagaataggtcaatcttcagaaacaatgttagctcggaagaagttaatgtcccatcaatccttcttttccataacagactgtttttgccgaatgtatacctaaaaatcaaatgttctaaggacatacgctatacattttaaatctttaattagacatctgcacatttaatctaaggctattatatagttttagattaacatgacttattatgatttttttaatactctgaggtaaactactatcaatttgctcttggctatatcctctgtacccaaaacagtgcctgtatattttaaataacgtaaatgaaaatggatgttagagaaggggagggaaggccagtattgttttcaataaagcctaaatcacttcaaaatttaatgtaaacaaaatatgtattttcccccaagcacttatataccaggaccactgtgtatgtcatgccaaacacgcaaagcaccataaagtgttgcaatgtggtttaaaattttcaagtatcttaaagaaagagtagtccagctatttcattttctatcttggatagatttatgtttaagaatgtgaattttaaaatacacaccacttagttaaattctatcagaaatatattttaaatctttaaaagtctcttgtttcttaacacccatgtacttttattttataatgcatgattgagattctttcatgttgatttcaaccttaattcctaacaaaatagaattcaaaattcaccaacgactcttattatagaagacttgtgtatgtatatatatctcacatagagctttaatcaaaactagctttataaatttagtatgtgcaaacacccacctaatatgattctataagaatggtatgaaactgtcttatgtgcaaggaaaaaaacatttccaaaaacaatcaactccttaaggagaaaaaatgaaggtaaagaaattaatataaatagtattaatcaaaatttttataattacaaatggtgccaaatttagcaggataaattactcttttgcttctaacaacaaatgtttaaaggaatgtacaagtaatgcttttaaatcacttggccatagattttgcttttgtatagtttgtgctttttacttttacatttgtaccatctttttgttgaaaattatagcttccacttatacaatgtacccattatttaaaatgatatttttcacattttcaagatattttgtaagttcagtagggtgatgattttccaaacccattaattatatagtttattgatctgcttggactttttacaataattaaataattatagatttaagtacataattttaataacatttaaaatgtaagcctcttttcattttacattagtcataaaagcatttgaatctttgtaaataatagtaaattattaacaaatatggagaaatcaattcagcaatctgtgtgaacacaagaggttttccttttacattttaaaaaatgccgaaaatgagatatcaaaattaggaaatgacatcttcttttcattaggcatgtaattattttacactatgtgttgacttccctagatcacaacagcttaaaagagggttaagccccaaaacacaaaacaaccaaaagattgtaatgcccgtactaatactttctaaactggctttgaaatagtcaccacttcatcacattccattttgttttattgtcttttcatgaaaataaaagtcttcccctaactggtaacatccacattataaatataaccttcctactccagagctataatttcagttttgactgccactcctgctattcaactgtcatcttctttatatgatgaagaagagcatctttttccaagtgagcctctgcaagagccattttagctttagccagttcctgtttaagagattcattctcttccatgagctgaaatgataaatggcggggggataagataatttaatcatttcaggaaatacagactatttatatagtatccaaaggtatgacacttgggatagtaaaaatgcccattgctggtgagagtgcacttaagctgaaaactgctttgagacaacatttggaaacatgtatcaagcacttaaaaaatgttcccatgttttgacccagcaatacaaaatactaactcctaatttcctagtctaatagtgacttcatttcatatgaattttcctggacctctctatggctttagacattgctgagctacacctactttctcagcctctctcctttttctggcttttatgccacagctgtttcatatttatccatttcaacctatgtatgcccttttcatcttttcttctactttttaagaactcttaaaatttgacattctgttagttccattgctcggtcgtcttctcttgtattgagtcactttcttggatgatcttatctctcatggctccaactatcatagactcacctagcacaaacctctctcctgagctccagactcaaattctgaatgtgtcatcagacattttctttttttttgagatggaatttcgctcttgttgcccaggctggaatacaatggcgcaatctcagctcactgcagcctccacctcccgggttcaagtgattctcttgcctcagcctcctgagtagctgggattacaagcatgcgccaccatgcccagctaatttttatatttttagtagagatggggtttctccatgttggtcaagctggtctcgaactcgcgacctcaggtgatctgcccgccttggcctcccaaagtgctgggattacaggcatgagccacagcgccctacagacattttcatctagatggccaatacgtctcctccaccacccttttaagacttagttcaagtattttatcctcttagagccattccctcataattaggaatggctatattagagcaaatatattagagcaaatatagccattcctaagtacggggatataaaactaagaactttctgcgtcacatagatacattaaaatatatgcagttaatttcaaatagttctcaaacttcttctaaatctagcttaagaattcttgccttatcgaccaagtgaggtagtttcctatacttctcttcatctgtagtatagcatctgacacagtacgttgtgactaccaattgaacactcttgtcccactagactttgagttcttcaatagtcacggatcatctactgctgaattctatatccctagctcagagctgacattgaataaatcctcattgaacagatgcattaactcattctatggttctatcatacagattaaaactctgctgaacattttgtttctttataatggcaaaaaaaaaaaatcaaaagcaacttgaatgttaataaatgtttatagaagtttcagaaatgatagcatacccaaaaccatattactaagccattaaaaaaaattaagcaaatacagcaatatgaaaaaattttgttaaacaattaagtaaaattatatagtatgtacacttgaatattaattttttcaaataaaaaatctacaaggaaaaatcacaaaaatactgagatagcactggaggaaggcagaaggtattaaatttttctttattttttgctcaacactctaaccatagcacctagcaaagcacctgggcacaataacaagcactcggtacattttattaaaataagtaaacaatgttttaactattagtatcttaatacctagttatttaattgctgaagctgaatctgaattaggtttcccattacctgttccctagtgaagtcaaaggagaactcaggaaagttagctgactgagaaggccaaggaacccctgggcttgtctgagtggcttgcgtgacactgcgttgtttcttcagatcatactttccactggtcagcagcactgaatcgcttttgacattttctttcaaatcatttccagtgttaagcatgtgagaatctgatcaaacaaataacatgctcagataacatttccaaatacttgataaatctttaaaagttccattgtgaaaatctaatttaaaactaaatatctatatatattagttatgaggatagtagtatgagatagaacaaccagtaaaaccaaaagcttattctctgaaaagatcaactaaataaacttttcttcctaagaattcttcccaagaatttgtcaacttcatctaagttaattacataatttattatgtttttatattaaaggtttattcgatttaatagatttaatttaaaggcttattattagattaactaataaacttttagttagactgaccaagaaaaagaaattactagaatcagaaacgaaagacgtgacattactaccaaccttacagaaataaaacactataaaggaatactataaacaacagtatgtcaataattagataacttagggcaggcacagtggctcatgtctgtaatcccagcactttgggaggcctagctgggagaactgcttgagaccaggagttggagaccagcctgagcaatgtagcaagacctgtctctataaaaataaaaaatacaaaaaactatgtaacttaagcctggcacagtggctcatacctataatcccagcactttgggaggccaagacgggtggatcacctgaggtcaggagtttgagaccagcctggccaacatgtgaaaccccatctctactaaagatacaaaaattaaccaggcatgatggtgcacacctgtagcctggcagaaggcagcctggaggctgaggcagaagaatcccttgaacccaggaggcggaggttgcagtgagctgagatctcaccactgcactccagcctgggcgacagagcgagactccgtctcaaaaacaacaacaacaacaacaaaaaaaaactatgtaacttagatgaaacagacaaattcttaaaaagacaataactacctaaatagcctcaagaagacaatgtcaatagacctatagctgagagagactgaatcagtaatcataaaactacccacaaagaaaagcccaggcccaggtggcttcactggagaattttatcaaacatttaaagaataatatcaaatctttaaaaactcttccaaaaaacaaaaggagcattcccaaactttctatgaaggcagtattaccctgatatcaaatctagacaaaacaaacaaaaaaaccccacaagaacactaagaccaatatgctgaagaatatagacataatcatcaacaaaatgttagtaaactgaacccagcaacatacaaacataactataaagcatggtcaactgggatttatcccaggaatgcaaatgtatctatcatccaaaaagtaactaatgtaatacatcaacagaataaaaggcaaaagccacatgatcatctcaatagatgcagaaaaagcatctgacaaaatccaatacctttccatgataaaaacactcaccaagttagaaatagaagggaacttcctcagtctaataaaaggtcatcatgtataaacatcccacatctaatatgatacttagtggtgaaagactagactcttttcctgttggccagaatcagaaaccagacaaggctgtctgctattgttacttttttttttttttttttttttttttgagacggagtctcactctgtcgccaggctggagtgcggtggcacaatctcggctcattgcaaccaccgcctcctgggttcaagtgattctcctgcctcagcctcccgagtagctgggactacaggtggacactaccacacccagctaatttttgcatttttagtagagatggggtttcaccatgttggccaggatggtctcaatctcttgacctggtgatccacccgcctcggcttcccaaagttctgggattacaggcgtgagccaccgcgcccggcctgctattgtcacttctattcaacattgttttagaggttctaacctgggcaactgggcaagaaaaacaatagaagacattcagattggaaaggaagaagtaaaattctctctactaaacatgatcttgcgtatagaaaaaaactaaggaaacaactaaaaacctactggaaataatcaagttcagtgaggttgcaggataaaaatcaatatacaaaaataaactacatttctataatgtgtaataaagaatccacaaatgaaagaaaacaattcgatttaaaatactgtcaaaaagaatacaaataaacttaacaaaagaagcacaaaacttactatactctgaaaactataaaacatcgttgaaagaaataaatagatctaaatagatggaaaaaattcccactgttcatggattggaagatttaatggaaatactccccaaatttatctacagctttaacacaatccctatcagaagttgagctggcgtctttgtagaaattataagttgagctggcttctttgtagaaattatcaagctgattttaaaattcatatggaattgcaagggacccaaaagagtcaaaaaaaaatcttgaaaaggtacaataaagttggacgactcacatgttccaattttaaaacttactctaaaggaagttggtaatcaagacagtgtggtagtatcaaagacagacatacagacaagtagaatagaattgagaatccagaaataaacccatgtgtctttaatccttacccatactcaaattgaacatttgagttaaagagctaaatttaacggctaattctataaaattcttaaaagaaaacatgagaaaatcatcatgacctcagatttggccatggactcttatacaggacatccaaagcacaggcaagaaaacagaaaagttgaacactgttgtcttaagaaattgccatagccaccccaaccttcaacaaccatggctgtcatcagtcagcagccatcaaccttgaggcgtgagcaaaaagattatgactcactgaaggtttagataatcattagcattttttagcaatcaagtttgtttgttttttgagatggattcttgctctgttgttcaggctggagtgcagtggcacgatcttggctcactgcaacctccgcctcctggattcaagcaattctcctgcctcagcctccagggtagctcggattacagatgtgcgccaagacacccagctaatttttgtatttttaacagacaagggtttcaccatgttggccaggctggtcttgaactctcgaccttaggtgatccatctgcctcagcctcccaaagtgctgagattacaggcgtgagccaccacgcccagccagcaatcaagtatttttaaattaagctatgtacattttttagacataataatagtgtaaacatgactttcatatgcactggtaaactgaaaaatttttatgacttgctttactgtgatactcactttattgtggtggtctggaacccaatcagcaatatatttaaagtatgcctgcataaggaagaagttcagcttccttcatgtggctatctagtcattccatcaccacttgtgaaaacgctattctttccctcattgacttgttttgccagccttgccaaagatcaatgaatgtaagagtttatctctgaactctcaattcaattcattccaattatcttttgccaagctccttttctactcaatcagctagagagcatttctagcttataattataaaagctgattagtactgttattttcaaatgtttcagaattgttgaatgtcttgtattttcctattttcttgttcatgtttatcccattttcttgcctataaatgctgtttctatttgccatagctgacctctagtgactgtgggaaaggaaagcttgctcttctgggtgagatacaccaagtttgttaactagatagggaatcattcccttcctgggggcttagcagctgcataatctaccctcaatattttagtctatatgcaaaccctactgaagtctactactgggcacaggcacaggggaggatcccaaaaaggaatgcccatattattcatgctgttgcctcaggggctaattctaacctcagtatcttgttggggagattcctcctatttttgaggaggaacttcagtcatgcagtcctcttggattcttttggtcctgtttctcactgcttcccagggaagaaggtatgatttatctgattgacttttttttaaagaactatatatatgtggttcagtctcttgctttggtatatgctgtaactcctgccaagagggtgcattcttttctgtttgtttgttttgttttgttttgttttttttaataagacagacctgaatttttgggagctaacacatttgggaaagagggctgggcagagtcttctcacagacctaagctatcctcttcacctgagctattatcagtaatgaagctaccattttgatctttgttggcctttctcctatgtctgtctccagttgttcccaaactacagaggaaaagactctttagaaggctcccactaactgttcctatatctgaaattgtcctgtcctttcttctgtagcactgttaatgactttattcttcagttgacacattttctgtcatttcatgaggtttttgataggagatgaaacagatgcacatgtcattccctcaactggctactaaaatagtgaagcccagaagatataaatctactgactcatgctctttccactactcactaccttaaaagacacagaccttacattagcgaccttaaaacttttgttagagtggagatgcaaacattaaaggtgaactaagtacacaggcaatacaccgaaagtaactaacgtacagaaaagtgccaaaagaagtggaagaactcacatcagattataaaaaagtgtcactatacaaggatgccctctctcatcattcctattcaacacagcattggaagttctggccagggcaatcaggcaagacaaagaaataaagggtattcaattaggaaaacaggaagccaaattgtctctgtttgcagatgatatgattatatgtttagaaaaccccaccatctcagcccaaaatctccttaagctgataagcaacttcagcaaagcctcaggatacaaaataaatgtgcaaaaatcacaagcattcctatacaccattaacagacaaacagagagccaaatcatgagtgaactctcattcacaattactacaaagagaataaaatacctaggaatccaacttacaagggaagtgagggacctcttcaaggagaactacaaaccactgctcaattaaataaaagaggacacaaacaaatggaagaatattccatgctcatgggtaggaagaatcaatatcgtgaaaatggccatactgcccaagttaatttatagattcaatgctatccccatcaagctaccactgactttcttcacagaactggaaaaaactacttgaaatttcatatggaaccaaaaaagagcccacatagccaagacaatcctaagccaaaagaacaaagctggaggcatcacgctatctgacttcaaactatactacaatgctacagtaaccaaaacagatacatagatcagtggaacataacagaggcctgacaaataacaccacacatctacaaccatctgatctttgacaaacctgacaaaaacaagcaatagggaaaggattccctatttaataaatggtgctgggaaaactggctagccatatgtagaaagctgaaactggatcccttccttaccccttacacaaaaattaactgaagatggattaaagacttaaatgtaaaacctaaaatcataaaaacccgattagaaaacctaggcaataccattcagaacataggcatgggcaaagacttcatgactaaaacaccaaaagcaatagcaacaaaagccaaaattgacaaatgggatctaattaaactaaagagcttctgcacagcaaaataaactatcatcagagtgaacaggcaacctacagaatgggagaaaatttttgcagtctactcatctgacaaagggttaatatcgagaatctacaaagaacttaaacaaatttacaagaaaaaatcaaacaaccccattaaaaagtgggcaaaggatatgaacagacacttctcaaaagacatttatgcagccaacagacatatgaaaaaatgcacatcatcactggtcatcacagaaatgcaaatcaaaaccacaatgagataccatctcacgtcagttagaatggtgatcattaaaaagtcagggaacaacagatgctggagaggatgtggagaaataggaaaacttttacactgttggtgggagtgtaaattagctcaaccgctgtggaagacagtgtggcgattcctcaaggatctagaactagaattaccatttgacccagcaatcccattactggctatatacccaaaggattataaatcatgctactataaagatatatgcacacatacgtttattgcagcactattcacaatagcaaagacttggaaccaacccaaatgtccattaataatagactggataaagaaaatgtggcacatatacaccatggaatactatgcagccataaaaaagggtgacttcatgtcctttgcagggacatggatgaagctggaaacaatcattctgagcaaactaccgcaaggacagaaaactgtataccgcatgttctcactcataagtgggagttgaacaatgagaacacatggccacagtgaggggaacatcatataccagggcctgttgggaggtgggggctggggggagggatagggttaggagaaatacctaatgtaaatgatgagttgatgggtgcagcaaaccaacatggcacatgtatacctatgtaaaaaacctggacgttgggtacatgtaccctagaacttaaagtataataataataataaaaaggaagtgtcactataaagaagacagttgagagaacaatggaaggatgaataaaatccacataatgatgagcaattccaatgagaaataacaaggcaaataagaacgtagagacgtgcaaagtgcagagaagtgcaaggtaagtaccattataaggagtataagtaggaaataaagctaagaaagagatcaactgagagacacaagcaagatcaaaggcctctctcactttctacaacattcaaaacacatttgtacaacaggtactaaaccaactatatatgaggttttttccagggtagaggccagtacatatatagatgatactttattacaatgtactgaaggtgtccctcaatcttccactactacatatgtatatacatataagaaatataataagtgaaaagaaacaatcagtaggtaaacaatttaacttcgaaatttgagtaggtgttcatttaaatgggttttcatcggctgggcgaggtggctcgcacctgtaatcccagcactttaggaggctgaggtgggtagataacctgaagtcaggagtttgagaccagcctggccaacatggtgaaaccccatctctactaaaaatacaaaaattaactgggcgtgttgacaggcacctgtaatcccagctactcgggaggtttaggtaggagaatcactcgaaccagggaggcagaggtttgcagtaggctgagatcgtgccattgcactcaagcctgggcaacaagagcaaaattccatctcataaataaacaaatagtttttcatatatacctctgatatgaaaagagccatcgtcacttctctctaccacaagatgatcaatatgtacagttacaggagctggttcaagggatactgtactactccggggactatcatcctacaggaaagaaaaataacattgacatgttacttcattcggtcatatttttaatgagttaaagataacacatgtatctttatatgtttcagctgatatagcgagaaaactgcctgttatattttgcctgttatatatttcctaatttccaaaaaagatctctacatcatttaccaaaaaagacaaaatcattttaataaatgctgatagaatatattttatagagaaggcacattcttagacatgaatgaaagtccagataaggaaaaggaacatgaaaatataaaattatttattaacatacttttaaatttattttcgtgttagaaacttgtatcttcattggcattactgttgcaacagtttcatcttccaaaaaatgttgaatattcataagagaagatgtaagaaactcagtgctgaagttttctatgtggcactgcagaaatccatttttttctgcaagtaaagagtgtattacagcaccaggcccactttcaaatctcagagaaatctcaggagaggatttggaatgaattacagctttctgatcggaacctaaggaaaatgaacatacaaaaatgtttgtagcattattcaataatattacaattatgtgccatgtagtacattaaaataatactagttttactatttccccctagtttaaatgatactctatagtacatatacaatatacgtacacacactaatttcaatattttatggcaactttctactacaataatgttgatttttctgtattttctgtttttttgataacaagaaaaacacattatgatagaactaaggtgtgatacatgcctcagatacttagtgtgtgtttgattgtgtacctaactatacattcaaatgttggctgtgaagcagaaataagtcagacatttaaagtgactcttaagccatttctcaagaagtaacaaaagcctgaggttttgcaccttcctcattaaattgggtccttaaataacctcattaaattgggtcctcaaataatggaaaagtaaacagaaaagacctcattaaattgtttctttagaaggcaaaccaaaaactgaaattatagtaaggggggggagagagagagagagagagagagagagtgagagtgagtgtgtgtgtgtgtgtgtgtgtgtgtgtgtgtgtgtgtgtaaaattacatttacttatgcctggaccctgtccccccaaaaaatttatagatggcctagagaggtataaacacatagtttaaaaacaaattttaaaattccaataatagaatatctaacttaaaaaacaaaagttcctagtgaaacccctgaagtaaattacttgtaaactcacactcagggtaaccattttgcttatttgttttatgctaattggttccaaaatgggtaagaggcaatatgcacatggtataatctgataaaaaatgaggagacatggaaaaaagtaaggatggaagggaaaaggggaaaagtagttggtaagattaataacccaaaatgcattatttaaattcctataccaaaaggtggaccaaaaatgagctccctagcaaaaaagataaaaatatgatcagttttgcaactcatataacctttaagataaaaacaaactcgtcctggaaaggcgaagctgtttcagtttctgaggtatgaaagttatttatcccacaggtcctcataagaagactgctatatcaattcatgatggagttttaaaaattcataatgagaaggtattttatttttcttcagcatgggtgtgactagtcttaaacaggtcaaatatatgcatgtgtgtgaaagggagagatttgcaagaaattaaagatgtgtgtatttatttacaccaaggataggtctccattcacaattccaggtggagaattgctcttgaatcttgtattccaggtacagaattatatttaattagtgttattactacttattaacattccagaaaataatgcaagagttcaaatctaactccaaagaattatttaaatatttcaaaattcaaatatttttattttttaaaatagaaggtaaaagaaacagccacaaattggtaatggttagtgttctttcccatagcaagaaaaacaagagtgaacttgctgaacaagagaacttgccaacaaacaacttgattaatgtgattttattttgcctttttatctgtctaggtctacacacacacacattctcatcccatggagtaaagccaggaataatttcaaacaaaatgagttttttggagacgaaataaaacaaaacaaaaattttcttcatcaaaatcactcctctctactaccccttataccatggaaccattaagctatgtcttcctattgaagctccacacactatagaaaaaaccactaactactaataataagtaaatgtaattttccttgaattcaattatagccaagataggattgctggtgagacatatataaaagttaaaacatattaaaccattgtatatgaaaaataattaaaaaaaaaaacttaccaactggacgattacaaaggtaatgccgaaggctgatattgcctaattggtctggtgtcacctggttcacttgaagacagatttctgtatcttcccctcggatgtcaatttccccattaacaccagtaattttaaataccacaacggacatctattaatgattgcataaataatattagtatgccaagcagttcaaaacaaaatttaagaaataatataggaaactaccattaccctctaaaaatacaattgtgacctaccagaccaaaagtatacttgtgacctacagaacacggttgttacattatagtgaaaacctttcatttacttaaaaaaaaaattaggtcacaaggattgtaaaatgtttttcattaaaagctagacataatatatttttcaagtctcccagaagtatttcactgcatcaggagggcttaaaagaaaccattagcttgggcaacacagtgagaccccatatctacaaaaaaatttaaaacagccaggtgtggtggtgtgcacctatagtcccagctactagggaggctgggacaggaagatcacttaagcccaggagttcaaggctgcagtgggctatggatacatctctgcactccagcctgggcaacagagtgagaccctgtctctaaaaaaataaaaataaaaatacaaaaagcaatacagaaaaaagaaagagcctccactcctcaatatgaataaaacaaatttagaaaagtaaaatcaaaggaaaaacgattggggggaggcattttcaagaacaaaagctgcaaattgaattgcccaccatctaagaattcattttatatatgaatgtctcaaaatatatacatgtcaaatatgaaataaagttggtggcatttatcttcatagaatctctctgaaatgattattaccaggtcatcatgattttcctgagcaccctctgaatttgtactgatggcatctggagaagtttcaccataattctgtaggtttgcaccagcattcacactttctgctgtgcccctgtaatttgtagttgagttctttttatttcctgaaataacacaaaagtaaattaataaattaaagtcagttttacacatgatctaacactgtatgcttatttaacaaaaatggactatcccttcaactctttctcaagcactgcctcctttaaaaaatggaccaagaaaaattagattgtaattagttagcaaacaatgaatgtgctataattcaatatttctcaaactatctgtggtaaaagacaattttttttaaaattcagtagccatcacagatcaatacttttaaaaaatgccataaaaatgaattaatagaaaaattaggtaagaaaacctaaagacatacaaaacataagtctcaatttattattgtatttactactctgtagtcagcttctaacatagtgcttggcaatgtggtaggtgctcaatacattattaaaaaaatggcccagggaaaatacctgtgaatacatttgtggtatgaggggctaataaaggcatttcataaggggttcctaacatcatcaggggttaagaagacatctctgataaaataatatttccactaaagtgaacaagcctgggtgtggtggctcacgtctgtaatcccagcactttggagagaggatcacttgagcccagaagttcaagaccagcctgggcaacacagcaaaatcccatctctaccaaaaatacaaaaaattagccagacgtagtggcactcgcctgtggtcccagctacttgggaggctgaggcagaggaccacttgagcctgggaggtagagactgcggtgagccaagatcacaccattgcattgcactctaggacagagtgagaccccatctaaaaaaaaaaaaagattccctttaaatttttttttttttttagatggagtctcactctgttgcccaggctggagtgtagtggtgcgatcttagctcactgcaccctccacctgcctcagcctctcgagtatctggaattacaggaacacgccaccacgcctggctaatttttgtatttttagtaaagacggggtttcactatgttagccagggtggtctcgaactcctgacctcaagtgatctgcctgccttggcctcccatagtgctaggattacaggcgtgagccactgtgtctggccccctctaaacaaatttttttaaaatttacatggaaaagaataattgcaaggagagcaaaaagacactctgaaaaacactgagtggataaaataatgagtgggaaaaataaagcgaagagttatccttaaccactctaattaaaattaaaaataataaaataaacagaaagaaaaagagcattccagaaacaggtacaacagactgagatggaaaagtttatcacagtaaagaaagtgagataaagactgaaataaactatgatccatctgaagtataacgagcacatgggaaaacatcagaaaaagtaagctggggccacatcacacagagcattgtcagtaatgttaaggattttaacttaatagccttaaagcaattacaagttatcagcagtacagtggaaaacaacatgatcaaatctatgttgttgttattttttcttttctgtttttttttttttttttttttaagacagagtctcgctctgtcacccaggctggagtgcagtggtgcgatctctgctcactgcagcctccgcctcccgggttcaagcgattctcctgcctcagcctcctgagtagctgggactacaggcgtgtgccactatgcctggctaattttttgtatttttagtagagacggggtttcaccatgttagccaggatggtctccatctcctgacttcgcgatccacccgcctcggcctcccaaaatgctgggattacaggtgtaaaccactgcgctcggccaaatttgtgttttttaagagtattttgcctggccaggcacagtggctcacacctataatcccagcactttgggaggctgaggcgggtggattatctgaggtcaggagttcgagaccagcctggccaacatggtaaaaccccatctcgactaaaaatacaaaaattagccgggtgtggtggcacgcatctgtaatcccagctattcaggaggctgaggaggcaggagaatcacttgaacccaggaggcggaggttgcagtgagctgaaatcacaccaccgcactccaacctgggcaacagagtgagacttggtatcaaaaatatatatattttttggctacagaataaagaatgaactgcaaatggataagaagagatgtggaaagactagttagggaccagaggtaggctgatagtccagttatgtgtttatatgtgttcataaatatgtacatacattcacaaatatgtatacatgcacgcatgcacatacatatctttttgtatacacatacctttgtatgtatctgacacacccacacacgtatataaaaatacatagataaaagcctggaagcatatacaccaaaagttgacggtagttacttctgcagtggggaatgatatcaaggagacagtaagggtgatatgatactaaggtgataacttcaatttttactctagggatttccatattatctggtttatggaaatgcctagagtaaaaaattgaagatatcacattagtatctcccttattctcctttttaaatgagagaatactcatatatttcttgtaaaattaaaacaaaacaaaataccaagagtctccttccaatgaaaattaatgaccctgacataaaaataagtcactgttcaaaagaaccaggaatgtatatcattaaaatgttacacacaaagtctacactttttaagatcctaaaaatagtctactgctggaatctattctaagatagtcatcaaaaatgcagacaaaaatttgtgaacaataatataattatagcacttttataactgataaattataaacaatctaaacatccaacatcagggaaatctttaaaaggctatggtacattcttatgacaattttatataggcttaaaaatattttcaaaggagtttaaataatattagagaatacttacagatgataaaaagtaggttacaagccaaatacataatatgacagcaaacatacatatatatgggtacatacacaaattcataaaataaataacagttgatatattgtgaatgtgagactttttggtgattttattctccaaattgtggttgtattttccaagttttccacattgagtggtagtcacttttacttattatttaattattagaaataataaaatcactgatgctttcagattaagtagggttatctgccagaagaacattgtttttgaaatatattttgatcataggacaaaaatcctctattaaggtaggattttaaatcataaagggggcacgggggaactagagttatctgcgaatctagaatagattttcatgacacacattagtacctcttctacatttaagtgatatgctggaaagaagattgctatgaattataacagagttagacagagaatttttgtttatgtatggtacacattccccaagtctggggagctagaatagcttaacggcttgttaaaaacttgggctcatcagtcagactagctgacaactctgcctcttactacttcctggctaaaacttttggactagataccttatttctttaagctttagtttctaaatctatagaaaagtgatcaataataataaccacctcatatgatggtcttaaggattagataaattaatgtgttttatagcacttggcaacatgactaagggtggtttaataaatgtttgctattgttgttattaaatatcatctatcatgtaaggtaaactgactagtgtctcccaccaagataaagtaaactggaatctagtagagagatttttctctgacttatgtaaagagtaaatttttttaagaagacgtgtttgtgtcagatagaagagctcagactttgaagtctgactaactgggttcaaatgctaaactctactacttactagctgcataactttgggcaagctgcttacctccctaggctttgtttgcctcacctttaaaatgaagataacagttcctacctcaatttatttgaagattaaatacatgtaagacgcttaaaatagtaactggtatagtaaatattagcttagaataacaaacaagaggccaggcatgttggctcatacctgtaatcccagcattttgggaggctgagatgggaggatcacctgaggccaggaatttgagatctgcctggccatcatggtgaaacctcatctctaccaaaaatacaaaaattagctaggcgtggtggtgggtgcctgtaatcccagctactcgggaggctgaggcaggataatcagttgaacccaggaggcagaagttgcagtgagccgagatcatgtcattacactccagcctgggcagcaagaaaaaaactacatctcaaaaaaaaaaaaaaaaaaagaataacaagaaagacaatcccagttctgcgtacaataatgtgactatgggaaaactacttaaacttcaggagcctcagtttccttatctgtaaaagaaggataagaataagcacttatacctcacagggttgaggcaatcaggtacatagtagacaataggctctatgtctgaatttaaaccactaattagctgtgttactttggattcgttatttaaccactctctgaagataacagtatactattgacagaattgtgaggtttaaattcattaatatatatacaaagcatatagaatggtaccaacacaaagtaaatgctcaataaatgttagcttctattattacagagttgtcactcaaattaaaagaagtaaactatttaagcacctgcaacagtatgaatgcgtccctttgaaattcatgtgttggcaaagtgatagtactaagaggtagggcttttaaaggatgatcagcccatgagagcttacccctacatgaatgggattaagacccttaaaaaagaggcttcaggtagcttctcttgacctccagaggactgcaaaatgcaacgcttacaatttgatgaggtttgatcttggacttcccagcctccagaactgtgagaaataaatttctgttctttataaattacccagtctgtggtattctgtgatagaacaaaacagacattgcttggcaataaatggtagctaccactatggtacttacatcaataatacatattatattattacttattatatacttgttatatttattatgttactaattatctaatctaagcttttcatctaaatcagtgggcttatttcctttcaaacagaaagtaattcaggccaggcatggtggctcatgcctgtaatcccagcattttgggacgccgaggtgcacggatcattcgaggtcaggagtttgagaccagcctggccaacatgacgaaaccccatccctagtaaaaatacaaaaattagccaggcatggtggtgcatgcctgcaatcccaactacttgggaggctgaggcaggagaactgcttgaacccgaaggcagaggtttcagtaagctgagatcacaatactgcactccagcctgggcgacagagtgaaaaaaaaaaaagaaagaaagaaaaaagaaagtaattcatatttgcctctggtatcctatgtttttgtgtctgcagcaactactttctgactatggcccatgcttctaattcctgtttacaaactccttaatgccttaatgagggagatgcaactaacaccttctaagtcatttctagcagtctttactggggcattggttgtctctcaataaaatgggaaaatcatgtagttacaccatatactatcatatatgtgaaagaatcctaattttgtaaatcagtagaattcaccatgcaaattaagcccacctaatcaaatttccaaatataggagtctctgtaatagaggctggtagccttaatgtcgcctgctttatggtctaaatgactgcatacatataattgctggatctcagccatagagaggcaggagtatctggttaaaagaaacaatggaacaaccattagaggaaagttaggtactcttgcatagtccctgtatgtataaataagtctttttggggggctataatgaacaattagaatatatctaaaaataactaaatattattaataattaacaattactaaatataagtagaaatattcagttatttttagttatgttcagtaactttaaaaagcatgggtacagttaacaattactgaatataactaaaagcatcccttttctcctaaggtgtatgtacgtaatatgaattcttaagccgtatcataactttacctttttccaaaaacatatggctatcacttccatcactttctaataactgttcttccaatatcatgctgtcaagtgaaatggtatccaatgacatttgtgaagagcttcttttcatattcttataagaaacacagagaggagccaggttgggtgggcaacgttccttaggctttccactgttaacaaaattattagaaaattattacatatagagaaaagaattctatctaaaaaatacttctaagagaattaaaatatgtatatagcatccatagctgaaattatatttaaacgtataagctcaaagtgttttcatattttgaaacatctactcttctacatgttaacaatgccatattttgtcatgagcttttctgcctcaaaacaaaatacactcataggcacacacgctccacaaaataaattaatttttaaaaaggccaataaaatgttgttaccttaaagatgactgtgatttaagtgttctaactgggggggtctcttctttactgatatccaggttttcagagagtgaagctgcttctggaagcaaatcttcagctttaaagatggactctatggtttcatttcctttactagttaaagtacttgaaagtatgttttgattaccatcactatcaaatgaaagtatattcgaatcttctctgtagtttaagatactacttgaatctgtataaaatgaatcctttttgtcacttgtttctgatccaatttctcctgagccacttttgtaaacaagtccactactttcatcttcacttattttccctaaatgtttatctgataaatagtccataaaagaaatgcctttttgcagatttgtatcactagctgatttaaaaagcaaaggatcctttaaagggatatggctaaggtcaacactcatagatctgttgtctgacatatgattaacagttacacttctaattctatttatatccctactaatttgttttctttttgaagacaaaaaatccccattttctgtaggcaaataatcaggtaccactgggctcacactttcagaaacaggagacttaagagtatttgcttgatccactggatggagcaaaagagccagttctgcacttctaagtaaaattccaatacaaatggatgtctgactagcaggactgccagttacagcttctacatctttccttaagttctctgaaagcaggataagtgactcatgcaggaaaagtagaagcagatactggtagtgattaatctgcatactgacatgtttatgaacatgaactaggagatgaatatctgcctctgacgaggaaggggaaaatctgaaaaatgtatctgatgaagaaggcttctgaccaccatttgtcaaaggctcagactctgtactataatactccttcaagagcttcttccgcttcaatcggccagccagatcactagattcactttgtgatgtatttagagatacctgattacaagtctgcggctctttttgtgactctgcatatcttgttggttgacaaatccaaatggaaagagggaatgagtctacaaaacttattggccgtccttttccacttttcatcccttcataatctatccaaaattgagaaaagtacacagcccaaacatccgtggcagcagaagttttaagagtgtttttattcaattggggagtaatatttcctttataaatttcatgcattttggtatcttgttcatgagcatgtctctggaaaattggatgtagaagattaaaattgtcacaagatttggggaagctggtatatgttttactaaaaaaatcacaatctttaaagtcttgaaacaaagcttctaggtcagaatgtcgacagtttggacagtgccttgtatttgtggcaatcatttcagaactctgaatagaaattgcacgtggctgatcttgatgacattcagatttcacttcagaaggaatgacaaactagaagagaagaaaaattaatctcatccaactggcaaatccatacatcttgaagataaaagaacatgacttagctcagaaattctttttcttgacctttcccccaaaatactactttcctattaagacgtaaaacactaactcttcccctcaaatcttattaaattgagtaaaggggacttacatgaccactaagaagagaatctttttaaaaaacataacatgaattaataatcaatgtaacatacatatacgcacaaatcataaaataaaaagaacaaaattaaatcattactactacttgtttgtatgatacctttagcattaagccatcaactcgaacatcaacatgctcgtcagattttgaattgtcattcaacttgtacacagccatgaactgattaagactctgttttaaatccaacagaaattgatttaaccatagaatgcttctttcatccacagtaaactgtagtgcattcagctggctatagaggttgggagatggaactgtggagacaagatgttttttaaaaatttttaattggatggttctaaatcttccctgagaacaaaaaatacatgtttagtcagttttattctttcttaagataaaacaaatttgaggtattatttacaaaatcaaagtgatacattggaatgataacaaacacatttagatagacaaaaaaaatttcccatgcctaactgaaaaaatgttttaatatttcaaaatatctataacatataaatatataaaacacatgaatattttgaatatataaattaatctaaaactaactgcataaaacaggaagcactgtttcaatttctttcctaaggttgtatttaccaagaagcaaacctctaaaaacattaccttcttgatgaagtatcacatcaaagtggtcctcgatcacatatttctgtagactttacaacctgaatcttaatctatatcttctaaaatgagagagctaagttaaccaatttcttatgaaagtgctatgctagcaggttctccttgaaaggagggaccgtgcataaatttattccccacttttaatcaaggcctataatagtgcttggagtaatgtaaaaaccaagtatctcctgaataataaaatgaattcactctttcatagctctcctaaaataaactaatatttacaattagagggtatatcacttcctgaaatatacatatttttctaccataaaagacattttgttttcagagcaccttgaagatcttttattctaaaaattcagacatatttattcctacaaaagctaaagttatgcatatctagagcatttagactaaatttaagaaaaataaatcaaaggtgtgagataccagtggagagggaacactgtaacaatgtcctgaatatggtttatttgcttatgttatttatttattcattcactttcctttaagattcactgaatgtcaactacattgtcttaccctaagcacaaagaaaacaaaaaaatagggcatggtcctttttccttaaaagttcgtagtttattacatgagacatatacaaacagagaaaaattacaatttaagtctatcagagacatgcaattgtgaagtggaggtgcctgccttttgggaatagaaataaagtgggtgctgcagagactgcatcacactctggaaggaaaggaagtaaagggaatatctcaacgtagattgattgatgatggtagtcacagagtagactagggagcaaatgctgcccaagactagagcacagaaagaaccccgatagcagatgtgggactgaaaaaggaacccaggacactaagcagtagaaagatctatatgcagggccggcgcggtggctcacgcctgtaatcccagcactttgggaggccgaggcgggtggatcacgaggtcaggagatcgagaccatcctggctaacacagtgaaaccccgtctctactaaaaatgcaaaaaattagccgggcgtggtggcgggcgcctgtagtcccagctactgggaaggctgaggcaggagaatggtgtgaacctgggaggtggagcttgcagtgagccgagatcgcgccactgcactccagcctggatgacagagcgagactccgtctcaaaaaaaaaaaaaaaaaaaagaaagatctatatgcagtttccaacagaagtctacttataaaacagattagtatgtagttaataatacttaaaagcagcttgtagaaactttgaatattctgatatcacgaagggaaagaagcagggtgcaaattaaatatgtaaaagaaatacatgcattaaaaacaagactaacaatgctatacttattgctatgggttgaattgtgtccctccaaaattcatttactgaaattctatccccctgtagctcagaatgtatttggagctaaagcctttaaacagacaattacggtaaaatgagttcactgggtgggccctagtccattatgactcatattcttataagaaccgaacaggagggacatacacacatacacagaaggaagaccatgtgaaaacaaaggggaaagatgaccatctacaaagagagcagtctcagaagaaataatcctgctgaagtcttcatctcggacctctagcctcagaactgtgagacaataaatttctgttgtttaagctgcatagtctgtggtatttgttatagcagccctaacaaatgaatatacttacgtttgagcagatatctaaaactgcaagcgtacaagcattgttttggctttttcttctttattgttaaaatacaatgtgtacgttactttcacaatggtaaaacgaaagttaagagattataaaagttggatcatttagttttgttcaaaacagagataatgaagaatgaaaattaactcatctacatgagggtgcaacatactatattctctacttttgtttatttttgaaaatttctctaagaaaacattaaattaaaaaacagttaaacttaatctagcaattccactaccaggtatctacaggggtcaagtttaaaatgcaaggaaggaattttgtaacttttttcagaaaaaaaagtacagattatagaatgagattataattcctttggtacatgctaacaaagcttgtataaataagcctggatggctgggagtgttgtctcatgtctgtaatcccagcgctttgggaggccaaagtgggaggatggcttgagcccaggagtttgagactagcccaggcaacagagtgagatcttgtatctacaaaaaatttaaaattagctggacatgatggctcatgcctataatcctagctactagcgaggctgaggtgggaaggtcacttgagtccaggagtttgagacggcagtgagccacgattgtgccacagtactccagcccaggcacagagtgaggctgtctcaaaaaaaaagaaaagaatttaaaaaaaaaaaacagcttagaagtcataaatactggaaactactcttaactctgaagaaaaattacttgttcagggacaaggtggcaggcgggaggcaggactagtttgcagctccgactcggatggacgtagcagtgtgtggaggctcacatagtgaatttttgctccagaatcactacaggaataaatcaggaaaactgggaggacccgtagaccctctgaaagaagcagattgctcctgcaggacctgagagacaacccaaatactgtgctggtactcacagctgagccacagatggttcacatcacagaactctgtgcagacaacccccagtaccagcccagagcctggtagacttgctgggtggctagatccagaagagagataacaatcaccacagcctggctctcagaatccacacccacaggaagaaagggagaataccggccaggcacagtggctcacgcctgtaatcccagcactttgggaggtcaaggtgggtggatcacctgaggtcgggagttcaagaccagcctgaccaacacagagaaaccctgtctctactaaaaatacaaagttagcctggtgtggtggcaggtgcctgtaatcccaactactcgggaggctgaggcgggagaatcacttgagcccaggagacgaaggttgcggtaagcctagattgtgccattgcactccagcctgggcaacaagagtgaactccgtctcaaaaaaaaaaaaaaaaggaaaagaaaaaaagggagaataccactccgagggaacatgccatgggacaaaagaatctgaacaacagccttcagtactagacattacctctgagagagcctacccaaatgagaaagaaccagaaaaacaactctggtaatatgacaagacaaggttctttaacacctccaacaaatcacaacagctcaccagcaatggacccaaaccaagaagaaatccctgatttacttgaaaaagaattcaggaggttagttattaggctaatcagggaggcaccagaaaaaggcaaagcccaatgtaaggaaatccaaaaaatgatacaagaagtgaaagaagaaatattcaaggaaatagcataaataaaaaccaatcaaaacttcaggaataaatagacacactcatagaaatgcgaaatgctatagaaagtctcagcaatagaattgaacaagtagaggaaacaaattcagagctcgaagacaaggtctttgaattaacccaatccgacaaagacaaagaaaaaaagaataagaaaacatgaacaaagcctccaagaagtctgggattatgttaaacaaccaaacctaagaataattggtgttcctaaggaggaagagaaatctaaaagtttagaaaacatatttgggggaataattgaggaaaacttccctgaccttgctacagacctagacatccaaacacaagaagcacaaagaacacctgggaaattcatcacaaaaagatgattgcctaggctcattgtcatcaggttatctaaagttaagatgaaggaaagactcttaagagctgtgagacagaagcaccaggtaacctgtaagggaaaatctatcagattaatagcaggtttctcagcagaaaccctagaaactagaagggattccagccctatcttcagcttcctcaaacaaaacaattatcagccaagaattctttatctagtgaaactaagcttcacatgtcaagtaaagatacagtgtttttcagaaaaacaaatgctgagacaatttaccactatcaagccaccactacgagaactgctaaaacgagctcaaaatcttgaaacaaatcctggaaacacaacagaacctctttaaagcataaatttcagagatctataaaacaaaaattaaaaaaaaaattaaaaaattaacaattaaaaaaaaaaaacaaggtatacaagcaacgaatagcatgatgaatggaatggtacctcacgtctcaatactaacattgaatgtaagtggcctaaatgctccacttagaaaatacagaactgcaaaacagataagaattcacctgttgtgggaagtcagggaccctgaacagagggaccagctggagccacagcagaggagtataaattgtgaagatttcatggacatttatcacttccctaataatattcttataattttttatgcctgtcttactttaatctcttaatcctgttatcttcgtaaattgaggatgtatatcacctcaggtccactgtgatgaatgcgttaactatacaaattgattgaaaaacgtgtgtttgaacaatatgaaatcagtgcaccttgaaaaaaaaaaacagaataacagcgattttcagggaacaagggaagacaaccataaggtctgactgcctgcggggttgagcagaacagagccatattttgcttcttgcagagagcctataaacggacgtgcaagtagtgaagatatcgctaaattcttttcctagcaaggaatattaataattaagaccctgggaaaggaattgcattcctggggggaggtctataaatggcctctctggaagtgtctgtcttatgcggttgagataaggactgaaatatgccctggtctcctgcagtaccctcaggcttatgagggttgggaaaagaccactccccagtaaatttgaggtcagaccagtgatctgatcttgaaccctgttttctgttgtttaagatgtttatcaagacaatacatgcacagctgaacatagacccttattaggagtttttgattttgccctttgccttgtgatctttgctttaccctttgccttgtgatctttattggcctcaaaagcatgtgatctttgttctcctttttgccctttgaagcatgtcatctttgtgacctactccctgttcatacaccccctccccttttgaagtccttaataaaaacctgctggttttgcggctcaggtgggcatcacggtcctaccaccatgtgatgtcaccccctggcggcccagctgtaaaattcctctctttgtactctttctctttatttctcagattggccgacacttagggaaaacagaaagaacctacattgaaatactggggacaggttcccccaatattcaccaaccatctgctgccttcaagagactcacctaacaaataaggactcacacaaacttaaggtaaaggggtggaaaaagacatttcatgcaaatggacattaaaagcaagcaggagtagctattcttgtatcagacaaaccttaaaggaacagcagttaaaaaagacaaagagggacattatacaatgataaaaggccttgtgcaacagtaaactatcacaatccgaaacatacatgcacctaacactggagttcccaaatttataaaacaattactaataggcctaagaaatgagatagatagcaacacaataatagtgggggatttcaatactcaactgacagcactagacaggtcatcaagacagaaagtcaacaaagaaacaatggatttaaactatactccggccgggcgtggtagctcatgcctataatcccagcactttgggaggccaaggcagccagatcacaaggtcaggagattgagaccatcctggctaacacggtgaaaccctgtctctactaaaaaaaaaaaaaaaatacaaaaaattagccaggcagggtggcaggcacctgtagtcccagctactctggaggctgaagcaggagaatggcgtgaacccaggaggcagagcttgcagtgagccgagatcacaccactgcactccagcctaggcgacagagcaagactccatctcaaaaaaaaaaaaactatactctggaacaaatggacttaacagatacttacagaacattccattcaacaactgcagaatatacattctattcaacagagcatggaactttctccaagagacagaccatatgataggccacaaaaaaagcctcaataaatttaagaaagttgaaattatatcaagcactctctcagatgacaatggaataaaactggaaatctacttcaaaggaaccttcaaaaccatgcaaatacctggaaattaaataacctgctcctgaatgatcactgggtcaaaaatgaaatcaagatggaaattaaaaaattcttcgaactgaacaactatagtgacaaaacctatcaaaacctttgggacacagcaaaggtggtgctgagaggaaagttcatagttctaaatgcctacatcaaaaagtctgaaacagcacaaacagacaacctaaggtcacacctcaaggaactagagaaacaagaacaaaccaaacccaaacccagcagaagaaaggcaatgaccaatatcagagaagaactaaatgaaactgaaacaaacaaaaacaatacaaaagacaaattaaacaaaaagctgtttctttgaaaagataaataaaattgatagaccactggcaagattaaccaagaagagaaaaaatccaaataagttcagtaagaaacaaaacaggagatactacaactgacaccacagaaatacaaaaggtcattcaaggcaactatgaacatctttatgtgcatatactagaaaacctacaagagatggaagaattcctggaaaaatacaaccctcctagcttaaatcaggaagaattagatagtctgaacagaccaataacaagcagccaaactgaaatgataatttaaaaattaccaacaaaaaaaagtccaggaccagctaaaaaaaaacacaaaacttaggaatatacctaaccaaggaagtaaaagacctctacaaggaaaactacaaaacactgcattaatgttagttacaaaacactgctgaaagaagtcatagacgacacaaacgaatggaaacacatcccaatgctcattgatgggtggaatcaatattgggaaaatggccatactgccaaaagcaatttacaaattcaatgcaattcccatcaaaataccaccatcattcttcacagaactagaaaaaaaattcaaaatctcatatggaaccaaaaaagagtctgcatggccaaagcaagactaagcaaaaagaacaaaactggaggcatcatattacctgatttcaaactatactataaggccatactcatcagaacagcatggtactgtataaaaataggcacacagaccaatggaacagaatagagaatccagaagtaaacccaaatacttacagctaactgatcttcaacaaggcaaacaaaaacataaagtggggaaaggacacacttttcaacaaatggtgctgggataactggctaaccatatgtgggagaatgaaactggatcttcttctctcactttacacaaaaatcaactcaagatggattaaggacttaaatctaagccctgaaactataaaaattctagaagataacattggaaagactcttctacacattggcttacacgaggatttcatgaccaagaacctaaaggggaatgtaataaaagtaaagataaattgctgacacttaattaaacagctttgcacagcaaaaggaacagttagaagagtaaacagacaacccacaaagtgggaaaaactcttcacaatctatatacatctgacaaaggactaatatccagaagctacaatgaactcaaatcaacaagaaaaaaacaaacaatcccaccaaaaagggattgatggctgagacaatgagtagacagttctcaaaagaacatatacaaatggccaacaaacatagaaaaaaatgctcaacatcactaatgatcagggaaatgcaaatcaaaaccacaatgcgatatcaccattctcacttcaagaaaggccataatcaaaaaatagtacatgttggcattgatgcagtgaacagagaatacttccacaccgctggtgggaatataaactagtacaaccactatggaaaacagtgtggagattccttaaagagctaaaagtaggcagagcatggtggctcccgcctgtcatcccagcactttaggaggctgacgcgggcagatcacaaggtcaggagttcaagatcagcctggttaacatgttaaaattttgtaaaaatacaaaaattagctagatgcagtggtgctactcaggaggctgagggaggggaatcgcttgaacccaggaagtggaggttacagtgagcctagatcgtgctgctgcactccagcctgggcaacagagtaagactccatctcaaaaaacaaaaaaggcactaaaagtagaactaccatttgatccagcaatcccactacttggtatccacccagaggaaaagaagtcattatatgaaaaagatacttgcacacacgtttatagcagcaaaactcgcaattacaaaacgtggaaccaacccaaatgcccagcaatcaatgaaaggataaagaaactgtggtgggtgggggtgtttgtgtgtgtgtatgtatatacatacatatatgtgcgtgtgtatatatatgtatatacatacatgtgtgtatgtgtgtatatatatgatggaatactactcagccataaaaaggaatgaattaatggcatttgcagcaacctggatgagactggagactattattctaagtgaagtaactcagaaacagaaaactaaacatcgtatgttcttcctcataactgggagctaagctatgagaatgcaaaagcataagaatgatacaatggactttgaggactcagggggaaagggtgggaagggggtgagggataaaagactacaaatagggtacagtgtatactgctccagtgatgggtgcagcaaaatctcacaaatcaccactaaacaacttacttatgtaacaaaacaccaccttttccccaataacctatggaaataaaaaatttttttaaataaaaataaaatagaataaaatttttaaaaattacttgttcaatgatatattttatttaagaaaaacaattatgggggcatggctggaatactatgattatgcaataacagacaatggccgtggtgaatacaggggcaaaggggagcagtgtaatacagtggagaaaaaacaatgaatttagatttacaagacaatgcttgagtttcaactgtgccattttactccctatgagatgcagagcagatgtcttccttcatctatcttgagttttctcatctgcttaggaaggcagctgagagaaacaaatgagaaacacacacagataaacaaaacaaaacaaaaaaccacaaaagattgttgaaacatgaagataggattaaatgccagaaggttttttatttttaattaattaatttttttttttttgagacggagtttcgctcttgttgcccaggctggagtgcaatggcatgatcccagctcaccacaacctctgcctcccaggttcaagcgaacagattacaggcaggtgccaccacgcacggctaatttggcatttttagtagacggggttttactacattggttaagctggtcttgaactcctgacctcaggtgatccacccgcctcagcctcctaaagtgctgggattacaggcatgagccactgcacctggccaatgccagaagtttaacccaaactaggaataaagcaataaaacagatagacagccttgtaattcccaggatgccatctcttaatttagcaacaaaggcaaaatctatggtataaggatcagaagttccttttgaaactaaaaacatatattaatagggtgggtgcggtggctcatgcctgtaatctcagcactttgggaagccaaggaggtcagatcatttgaggcctagagctcaagaccagcttggccaacaaggagaaaagaaacctcacctctactaaaaaaaaaattaacaaaaatcagccagatgtggtggtgcatgcctgtagtcccagctactcaggagaatcacttgaacctggtaggcagaggttgcagtgagctgagatcgcaccactgcatgccagtctgggcaacagagcaagaatctgtctcagaaaaaaaaacaacatatattaataaatcaatattaaataaatgggcaagtaggtctaagtattttggagttctacttttaaagaaaggacataaaacttgttatgcctctgataacaaaacctatttcatctaaatattttcaactatgattttcagctagcatgatgaaaaaggtatcacagaaaagagggcaacatttagtttaagaattccgagatgggccaggtgcagtggctcacacctgtaatcccagcacttcgggaggctgaggtaggcagaccacttgaggccaggagttagagaccagcctggccaacatgacaaaaccctatctctatcaaaaacacaaaaattagccgggagtgttggcacacacatgtagtcccagctactcggaagcctggggcacaagaattgtttgggcccgggaggcagaggttccagtgagccaagatcacgccaccgcactccagcctgggtgacagagcaagactatgtctccaaaaaaaaaaaaaaaaaaaaaggaatttctagatgaactgagacaatagcagagagttttaatattcaaagaatacaaatgtacaatcattttaatgttaggaagctaaagagttttaatattcaaagaatacaaatgtacaatcattttaacgttagaaagccaaagaagcttctaaaaataaaaattcatgtaattcaatatttctgaaaattgtaaatgctaaaagttgcccaaagtatacatttaggcattttaaaacagtcaaaaaaattctctacagctaaaaggacaacttcagttactttttcaataatatataaatgaagttatatagctgacatataaatggagttttactaaggggaaacaaatgactttattctacaaataacctagctttcattgattctttaacaaacagctattaagcacaaagtaagttgaatatctggaataaaatgaacataaataccagatgtgctggacatggcggctcatgcctataatcccagcactatgggagtccaaggtgggcagatcacttgaggtcaggagttcaagatcagcctggccaacatggtgaaaccctgtctctagtaaaacacagaaaaattagctgggcctggtggtgcatgcctgtaatcccagctactcaggaggctgaggcacaagaatcgcttgaacctgggaggccaaggctgcagtgagccgagatcgtgccactgcactccagcctgggcaacagagcgagactctgccttgaaaaaaaaacaaaaaacaaaaaacgaaaaaacctcatgattcctgccatcaaggattctacaagctagggagggaaaaggatacataaacaaataataacaacatctaaaactgttagactagacttatgcactatacacaataagaataaagaacaataggggctgggcacagtggttcatgcctgcaatcccaacactttgggaggccaaggcaggagtatggcttgagcctaggagtttgagatcagcctgggcaacacagtgagatgctagctctcaaaaaactaataataaataaggaacaatacagttttatttatttttcatatttataaaactcaaaaatattaacaagaaaaaaatactttctcaaataatggacaaataataattaaaaactctcttacttggaaaatcctttccatctggatagtaatattctgtgaattctatatagacagctgacatttcttgtggaagatatagggattttttattgcagcaaatcatgcttttgggggaagaacgacattgttccgctgtagagacctgaaaagataaataagtttactgaaatcacactgaataaaaacctttccaaataatttatgcaacccagacagtacttttaaaactacttacaaaactttgctaatggttaatttccagtgtaaactttattatatatttaacttcacatggaattatttttaaacacccatcaactattcagaaaactctataatctttttggatccttatcaatcacaaaatcaacactgtacaatattccttacaaacttattattgtgagccttaaaaacaacagaaaaatgataacgatattctatcagataatatagataagtaaatggcagtcaggacatagatccaagtcctcaaatccagaatgcttccccgtacgctgtttaaaataatctttaccataatctctccattaccatgaaaagtaacagagctatatacagtttctgcttgagataataaaaattctggagacaaataatggtactggttacacaacaacgtgaatgtgcttaacgacaattattatataatatatagatacagacacagattttttttttttttttggtagagacggggtttcgccatgttggccaggctggtctcaaactcctgacctcaagcaatccacccacctcagcctcccaaagtgctgggattacaggcgtgagccactgcacctagccgatattattaggttggtgcaaaagtaattgcagttttgccattactttcaatggcaaaaacctaaatatgtatatgtgtgtgtatatatatataattattattgtaaattcagtcataccttaccacaataaaaaattaatttaaaaataatagctataaacacttccgtcaaatagtttgatcgctcgaattcattttccaaaaagactatgtttcatacacaaatcaataaatatgattcaccacaaacagaactaaaaacaaaaaccatatgattatctcaataggcaaagaaaatgcttttgataaaatccaacgtcccttcacaataaaaaccctcaacaaactatgaatcaaagaaacatacctcaaaacagtaagagtaatctatgacaaactcacagctaatatcgttctgaagcggcaaaagctgaaatcatttcccttaaggaatggaacaagacaaggatgccccctctcacaactcctactcaaaatagtactggaagttctagctagagcaatcaggcaagagaaagaaagaaagggcatccaaataggaaaagaagtcaaattatttctcttcgctgacaatatgattctatacctagaaaatgctaaactccacgaaaagactcccatgactgataagcaacttcaataaagtttcaggatacaaaatcaatgtaaacaatcagcagtatttttatataccagtaacattcaagctgaaagccaaacaacaacaacaacaacagcaacaacaaatcctaggaatacatctaaccaaaagataaaagatctctacaagaactgggccaggcatgatggctcacacctgtaatcccagcacggtgagaggctgaggcgggcagatcatttgaggccaggagctcgagaccagcgtggccaacatggcgaaaccccatctctaccaaaaatacaaaaatcagctgggcgtggtggcacacgcctgtaatcccagttacttgggaggctgaggcataaaaatcgcttgaactcgggagacggaggttgtagtgagctaacaccactgtattccagcctgggcaacagaacaagactctgtttcaaaaaaaaaaaaaaaaagtccacactgctgaaaacaatatacagactcaatgtcattcctatcaaactacaaacatcattttgcacaaaattagaaaaaaattttaaaatatttaaaaattcatatgaaacccaaaagcctgaatagccaaagcaactctaagaaaaaagaacaaagctggagacattacataactatactataaggaaccaaaatggcatggtactgatacaaaaacagagacatagatcaatggaacagaatagagaacccagaaataaaatcgcacacctataactatctgatctttgacaaattcaacaatcacaagcaatggggaaaggacaccctattcaatgaatggtgcctggatgactggctagtcatatttagaagaatgaaactggacccctacaccttccttttttttttttttgagacggagtctagctctgtcacccaggctggagtgcaatggcatgatctcagctcactgcaacctctgcctcccgggttcaagcaattctcctgcctcagcctcctgagtagctgggattacaggcgcgcaccaccacgcccagctaagttttgtatttttagtagagatggggtttcactatgttggccaggctggtctcgaactcctgacctcgtgatccgcccacctcggcctctcaaaatgctgggattacaagtgtgagccaccacgcccggctacaccttctactatatacaaaaattaactcaagatggaacaaatatttaaatataagaagtcaaactataaaagtcctagaagaaaagctaggaaataccattctggacataggctttagcaaagaatttatggctaagacctcaacggcaatcacaacaaaaacaaaaatagacaagtgagacctcattggagagcttctatacagcaaaataaactatcaacagagtcaacagacatcctacacaatgggagaaaatactcacaaattattcatctgacaaaggtctaatatccagaatctataaggaacttgaacaaaagtcaacaagcaaaaaccaaacaccattaaaaagtgggcaaaggacatgaacacacacttctcaaaagaagacatatgtgcagccaacaagcatatgaaacaatgctcaatacactaatcatcattaatcatcagagaaatgtaaatcgaaaccacagtgagataccatctcagatacattagttagaatggctattattaaaaagtcaaaatacagatgctggtgaggctgcagtactgcatgttctgacttacaagtgggagctaaatgttgggtacgcatggagacaaaaaagggaacaacagacactggagaccccaaaaggaggatgggaggaaggggaataagggctgaaaacctacctgttgggtactatgctgaccacctggatggtgggataatcacaccctgaacctcagcatcatgcaatataaaaatgtaacaaacctgcacatgtaccctgagtttacaataaaagttgaaattaaaaaaaaaaaaactattagttttaaggttctggttacatttttttcaccccccaaaaccagctaatgtcatcaaaaatgtatatattaatattcacaaagttcaaccaataaagttttatcagtttcatttatttgttttagtttagtatacccagagatgtttttttttccattcatcattcaatagacgtgtatatgtctcatatgaagtagaataatttttcaatggtttacttacgtttcctcttatataaactgcctcagcaatcttttttttttttttttttttttgagataagagtctcactctgtcatccaggctggagtgcagtggcacaatctcggcccacaacaacctctgcctcctggactgaagcgattctcgtgcctcagcctcccaagtagctgggactataggcatgcaccatcactcccagctaatttttgtatttttactagggagggggttttgctatgttggccaggctggtctctaactcctgacctcaagtgatccacccactttggcttcccaaatggctgggattacaggcgtgagccaacgtgcccagccaaattgcttaatcaatcattttaatttgtatagtctttataaattcaagtcagttccttacagtatctaattaaaaagcttttctctgcatatatggaaacaaattcttttcaattcaaaatgtcaacttattttaacaaataacggcttattcttttttcctctaatagttaaaaacctattcgaattgggacaaacatactatcttatgttcttctacttacttttgtttattttgttttgtgtttggtgtggttgcgtatatatatgtggggtttcttactgtatttcactcacaaccatgtgggattataagtgattcctctttctcatttccacataaatttatttaaatcctaaaatttaaagtcttttaaaaagctggagcatatggtcatgcaccatataatgacatttctgccaatgacaggccacttataagatgtggatcccataagattataacacagcttttatactgtatttactgtatttttactgtatattttctatgtttggtaaggtttaaatacacaaataccattgtgttataactgctacggtattcaatacagtaacatgatatacaagattaaagcctaggaggaataggatataccatacatatagcctaggagtttaagtaggctacataccatctaagtacagttaatgatgttaagcaacacatgactgtatatcgaatgtaaagtaagtagtaactgcataatgagaaaataactgttaaatcagtttctaaacattggcacttctgacgttttaagctagataattcttcattgtggggaactgaccagcacattgtaggatttaacaggcggcatcactggtctttactcactagaggtcagcagcatccctgtccagttgtgacaaccaaaactatcttcagatattgccaaatgtcccctggggggcaaaattggtcccagaggggaatcactgagttaaataaaaacttttcacataaaactaagtctcaaagccacagacttatcaaaataaaccagaacaatttataaatgataaatctagaaatcttttattttttaagaatagatcatatattatcgtgttggtctcaaacattgcaattagaccacgttaggtgattataaactgagtaagattgttagtataaataggacagagttcttagctatagaattatattcacagtatagccaatacagtatatatagtatactgtagttccgtaaagcaaaaaaggcattttagatccttccacagagactactgtgtaataaggaaattggtctccctctgaccctgctcctgggaagcaactaggaattggaatttcctatttatggttggcccctgatatagtttggatattgtcccctctaaatctcatgttcaattgtaatccccagtattggaggtggagcctgatgggaggtgtttgagtcatgggggcagatacctcatggcttggtgatgtgctcacaacagtgagttctcataaagtctggttgattaaaagtatgtggcacctccctgcgccactctctgtcttgctcctgcttttgccatgtgacgtgcctgctcctgctttaccttccaccacgtgtaaaagttccctgaggcctcctccccagaagctgagcagatgcccacatcatgcttccaatatagcctgcagaaccaaaagccaattaaacttcttttctttataaattatccagtctcaggtacttctttacaacaacacaagaacagcctaacacagcccctgacaccacagctgatagtttatgatagcaaaacgacgcagggtggagctggccacacttgatagcctagttgcgttaagagggtgggggctttgggtaatctgattaccaattcacctagagattgagtaaaacctcatgaccaatacttcatgcatattgttaaatatccatccatccatatatttacacatctatatagggttccacatccttagaaagctaataagtcctgaggaaaagtttcacatttcaagtgctccaagacgctgttttattattattacatcagtgtactgtgggggtgatatggtttggctgtgtccccaccaaaatctcatcttgaattgtaactctgacagttcccacgtgttgtgtgaggaacctggtgggaggtgattgaattatgggggcaagtctttcctgcactgttcttgtggtagtgaatgagtctcacaagatctgatggttttaaaaataggagtttccctgcacaagctctctctttgcctgccaccatccatgtaagacatgacttgctcctccttgctttctgctgccatggttgtgacttccccagtcatgtggaactgtacgtctattaaacttttttcctgtataaattgcccagtcttgggtatgtctttatcagcagtgtgaaaaccgactaatacagtaaattggtactagtagagtggggcactgctgaaaagatacctgaatgtggaagtgactttggaactgggtaacaggcagaggttggaacagtttggaggggtcagaagatgacaggaaaatttgggaaagtttggaatttcctgagacttgttgaatggctttgacaaaaatgctgaaagtgatatgaacagtaaggtccgggctgaggtggtctcagatggagatgaggaacttgttgggaactggaagaaaggtgactcttgttatgttttagcagacgggcagcattttgcccctgccctagagatctgtggaactctgaacttgagagatgatttaggttatcttgtggaagaaatttctaagcagcaatgcattcaagggtgacttgggtgttcttaaaggcatttcattttataaggcaaggagagtataaaagttcaaaaaatttgcagcctgacaatgcgatagaaaagaaaaccccattttctgaggaagaattcaagccagctacagaaatttgcgtaagtaaagagaagcctaatgttaatccccaagacaatgggggaaaatatctcccagggaatgtcagaggtcttcacggcagcccctcccattataggcccagaggcctagaaggaaaaagtggtttcatgggccaggcccaggctccctgtgctatgtgcagcctagggatttggtaccctgcatcccagctgctccagccatggatgaaaggggccaacacagagcttgggccatagcttcagaaggtgcaagccccaaccctggcagcttccacatggtgctgagcctgctggtgcacagaagtcaagaactggggattgggagcctccgcctagatttcagtggatgtatggaaatgcctggatgcccaggcagaattttgcagcaggggtggggccctcatggagaacctctgctagggcagtgtggaagggaaatgtggggtcaaagcccccacacaaagtccctactggggtaccacctagtggagctgtgagaagaaggccaccgtcctcctgactccagaagggtagatccactgacaccttgcaccatgtgcctggaaaaggtgccagcagacactcaataccagtccatgaaagcagccaagaggaaggctgtatcctgcaaagccacaggggcagagctgcccaagaccatggaacccatctcttttttttttttttttgttttgagacagagtcttgctctgttgcccaggctggagcacagtggcgcgatctcagctcactgtaagctccgcctcctggaaacccacctcttaacatcagcgtgacatgtatgtgaaacatggagtcaaaggaaatcattttggaacttttaagatttgactgtcctgctggatttcggatttgcatggggcctgtagcccctttgttttggccaacttctcccatttggaatagctgtatttacccaatgccttgtacccccactgtatctaggaaataactgaattgcttttgattttataggctcataggcagaagggacttgtcttgtctcagacaggacattggactgtggacttctgagttaatggtgaaatgagttaaaactttgggggacagttaggaatgcatgattggtttagaaatctgaggacataagatttgggaggggccagggcagaatgatatggtttggctgtgtccccacccaaatttcaccttgaattgtagctctcacaattcccacatgttgtaggaggaagctggtggaaggtgactgaattatgattgaaggtgattgaattatgggggtgggtctttcctgtgctgttcttgtggtagtgaatgagtctcatgagatctgatggttttaaaaatgggagtttccctgcacaagctctctctttgcctgctgccatccacataagatgtgatttgctcctccttgccttccgccatgattgtgaggcttccccagccatgtggaactgtatgtctagtaaacctctttcttttgtaaattgcccagtctcgggtatgtctttatcagaagcatgaaaatggactaatacagaggaggaaaaaaagactctgccttatgcatctcttcctatggctggttgtaatttgtataatgtgactacaatggatgtgactttaatatatttcagtggttctgtgagtctttctagtgaattttgaaccagagggtagtttttggaaactcccaaagttgtagttggtgtctgaagtctttatttttgttcttccaacttttgctttagttcagggggtacatgtgcaggtttgttatactggtaaactgcgtgtcactggggtttggtgtataaataatttcacaacccaagtagcgggcatagtacccgttaagtagtttttcaatcctcacccttccccaaccctccaccctcaagtaagaccccatgtcttctgtttccctctttgtgtccatgtgcactcaatgtgtagctcccacttataagtgagaatatgcaatatttggttttcttttcctgcattaattcacttgggataatggcctccagctgcatccatgttgctacaaagaacatgactgcattcttttcatggctacatagtactctgcggtgtatatgtaccacagtttctttatccactgcactgatgggcatctaggttgattccatgactttgttattgtgaatagtgctgccatgaacatacaagtgcacgttatctttggtagaaaaatttatattcctatgggtatatacccagtaatgggattgctgggtcaattggtagttcttttttaaattctttgagaaaactccaaactgctttccacagtggttgaactattttacattcccaccaacagtgtataagcattcccttttctccacaacctcaccaacatctatttttttgtgttttaataacagccattctgagtggggtgagatggtatttcactgtggttttgatttgtatttctcagttgattagtgatgttgagcactgtttcatatgcttgttggctgcacatatgtcttcttttgagaagtgtgtgttcatgtcctttgcccactttttaatggtgtttggtttttgcttgtcgattcaatttccttataggttctggatattaagacctttgtcagataaataatttgtgaatattttctcccattctgtaggatgtctgttgacagtttattttgctgtatagaagctctttaatgaggtttcacttgcctatttttgtttttgttgcaattacttttggagtcttcctcatgagatcttggccgaggccaatctctagaattctatttccttggttgtcttccagggtttctatagtgtcagcctttacatttaagtctttcatttcatcttgagttaatttttgtgtgtggtgaaacaacagggtctaatttcaatcttctgcatatgaccaaccagttatcccagcaacattattaaataggaaagcatttccccactgcttgttattgtcgactttgtcgaagatcacatggttgtaggtgtgcagctttatttctaggttccctaatctgttccattggtctatgcatctgtttttgtaatgagaacatgctgttttgtgtcagaagcatttaggcaaacttaaggactgtgcctataaagttagtttggttaactgagtaaccatataatcaaaaattaataaactgatattttctatgccatctaatatggccatttcataaaccttgtaaagattttttaaataaaatggtagcatttgttatttaagttgcttagatgagatactaaagtgtttatgagaaaacttaattggaaaagaaaacatacctggtatatattgaaatctgcaagtctaaccacaacagaactagacattagcttagcttttgattgttgagataatactgaaggtgttctgcatgtccctttcagagggtagtccttctctgttggaaacaaaaactcctttcaattcattgcaaaattatttttaacagtcactcttttattattaaggcaggtaccagaaatatatgtgaatactaacttctcaaacaagataatatttgtggacatactttataaattataaagtaatacaggatgtaagttattgtgatgattattcttttaagaagaatcacacatgtcacatttaagttagtcttctacaaaaactctggaatgggactcttgttaaaaatgacatatttacatagaagtagaaagtgaagggtatgggggagggaaggggaggggcagacaatgggtgattagtgaatacaaaggtatagctagataggagaagtaaattctagcatttatagggtgactataattaataatttattttttcaaatagctagtaagagcagattttgaatgctcccaacttaactaataaatgtctgaggtgacgaatatgctaattactctgcttttagtgttatacgtttgtatacatgtatcaaaatatcacatttcaatgcttactgggccagcaaaaaaaaaaaaagtagtagtatcacactgtacctcataaatacgtacaattattatgtgttgacttaaaaaaaaaagaaaccttctagaaaaattcttcctgggtgtgactattattggttgtattaattttaaaagtgctttggtccacaagcctatgttggtctgagcaaaggatacaggggttttagacattaattaaaaatacttggcttaggccgggcgtggtggctcacgcctgtaatcccagcactttgggaggctgaggtgggcagatcacttgaggtccagagtttgagaccaccctggccaacacagtgaaaccctggttctactaaaactccaaaaattagctgggtatggtggcatgtgcctgtaatcccagatactcaggaggctgaggcaggagaatcgcttgaacccgggaagcagaggttgcagtgagccgagatcacaccactgcacttcagcctgggagacagagtgagaccctgtctcaaagaaaaaaaaaaaatacttggctgggcatggtagctgacacttgtaatcccagcactttgcggagggccaaggtgggaggaccgcttgaggccaggagtttgagactaccctaggcaacatagcaagacccccatctctacattaaaaagaagaaaaaaaaatactcatttacaggaaatactatgatcacacacacacacacacacacacacacacacacacacacacacacacagagtgcaaacactcttaatattaggggaatgctattataggtaaaatacctgtttgtgtgtgctggggagaggcatgtgttggggatttaggaggtgaacctacattatgatccttcacagcctgtttaagcatttcaacgttgcactcaaattcatgcaataactcattggcccatccattttttgttttggttgcatcactaaaatacatccaatgattacaactatctcctgtaaaatgaacaacaggtatttcattgaaaaatgtacaactttcatttattatattatagtaatgcttccaatgagatttagtcgtttattcaagaaagactttgatatctgaaaaatttacaggcttcacctacatgtaatttcgaaatatgagtaaaacatttgaaacagagggaaagaatgtcaaaagcaaatcatctggaggagtttctatctagtacccattcttagtagaaaatcactaagattcaatttaaagccatatgactcgtcacccttcactggatgctcaattacctggtaaacctgcattaaactgaatcccagaaaatattatcaaataaatagaatcctttcttcaaagatgtgttatcaagttaactaacaaaaacctaaaccacaaaaatgataagatgatgatgattaaaacatttaagaaaccaataaaacttctcaagatgtactcagccatagttagtttttggaagaaaaatatataatcagaatcattaggcttctctgtagcaactaagaaaaatgcacataaaagggttaagacaataaaatcaggccaggcgcagtggctcacatctgtaatcaatcccagcactttgggaggctgaggcagaaggtcgaggctgtagtgagcagtgatcacaccactgcactcgtgaggccttggatcaaaaaaaaaaaagaaaatttactctatgaatgtttcacacctcttcaaaaataaatatctagttaaaaattttatgcatttgtaagttaatttatgagtcaggacgatagtatataagacaaaatccttcaaaagagaattattatattgaatgttggcaatgaaaatttaaaatgaaaaaaaaatcatacaacttttaaatttaatcaggtaccaacatagaaatgacaaacattggttaaaaaacgtgtaaacaaaaatgtgtgaacagaaaaactttaccattttttaaatgtcctggaaaactctatgatctctagtttggtttttctcacttgtgtgaatgctaaatactaacagaaggcaaaaacggtataaagtcaaattaatttggtcacaataatcatactttttttttcttttcattatttgggagaaagaatctaccaataccagattgttaagagcctatgaaatctggaatcctataatttagctaaacatactcttattcttagcttcatactcttttcattcctagcttcatactcttttctaatttttaaatatataaatcatttaaaaatttaaaacattaataacttgttttggtcacaactaacaaaacagcacaaacacatgtcctctgtaccctgatttttttttaagttttaaattggttatttggaaaactgtcaatttctaaaaattatgatttctaaaaatctatataaatgtcaatatacactgtatgactatattccatggcaattctactttcttaatgaaatactgccaggagaaaaataccaatctcttcatctcatttcttgttaacaaataaaagcaagataaaactaaactaaataaattagctatataatttgaaaacaacatttatatcttttaaagatgctgttatacacacctgctttatgataaggataataatctatagttagctgtgtaaaagagagttgcattgcccctccagtaatacgtctgtttgactctgggaaaaaaaaagggggggggggaaatattaagtcaattatcagaaagatttaatttaccacagaaaaattttagcatacttggagtccaaatagtaataactgtctctcttttatgacggcacattaaggattttaggaaatataattcaatccaatgagtatttactgagcccccctcatttgtaaggcaccaggataaaaggtaagaatataagaatagcagaatccctgccctggtagagttcacagatgatactagcacaacttttatattgacaaggcctccccatatgtcaggcattattttaaatactttaggtaaacttactcatttggttttcataacaaccgcatttgataggtacaatcattattatccccatcttcaagataaggaaactgaggcacaaagaggccaaggacatacagctagttaagtgcaaagcttggatttgaacccaggaaatcttgaacactacaccatatcatcctacctcttactgaaaaggaaattaaggctgggcgcggtggctcacgcctgtcatcccagcactttgggaggccgaggcgggtggatcacgaggtcaggagttcgagaccagcctggccaacatagtgaaactccgtctctactaaaaatacaaagattagctgggcatggtggcacgcccctgtagtcccagctacttgggaggctgaggcaggagaatcgcttgaacctgggaggcagaggctgcagtgagccgagtttgagccactgcactccagcctgggcaacagagtgagactccatctcaaaaaaaaaaaaaaaaaaaaaagggaaattattaaaagtctgttaggttaggtaagttgtccaaagtcacacagctatagtaaaatcaaaagtagattacaaattggtataacgtgaacataaaaatcaaattttaaaacaaaatgggcaaatcaatcagaagaaagaaaaatactaactgagacatagctatgtatacactccctatattaatttgtaaaatccaatttatctcaactagtagaattttcagcacaggtctacaatcccttacgtaaaacctttggaaagccaaatgtttcagaattcagaaatgtttagatttcacgacagtaatatgatacggtatatacaggatataccatgcaacactctcagcaggttctgaggcagcactaataaaaatagcaattctgcagcaaaacataaatatttataggaagcaggcaaagaataaaaaaaagtattggcataagtcaggttttgccaccaaatgagtttttcacaaacttataatatttcagagccttttggatttcacaatagtgattacagacctgtactattaaggagatattttggtgaaaaggttttcttcctaaataaaatcattcaatttattctatcagggaatagtgaggaatgtaaggccttagaaaacactttctccattctcattcttactacttaatcttgaccacctcattttcttagtttggtttgttctaacttttttggattttcctttcaaatctctaaagtaaaagatgccaactataagtcaaatgacacaatggtagtcagaacaaaagataacaaatccctccacaaaccccgaatcttcctcacctttgcccctccaaccttttaggctggaatcttttaggctgccttgtctaatgaaggcagggtaacttctactgctaagtatccagggtctcaatattcactttctcagcttaaaaacacatggcaaaaatttttgtagatatagatcctgattcagatctgaggcacagagatcagataactctattgtttaaaggtcttcagcctgattctaatgctcaccaaagtttgagaattatagtccttaaggtaggcctacctgctgaactcaaccccaacacttctgggccagggatgctctccagcagagaaacaaaaacgcccagcgcctagattacagaactacatctactaaataaggaaaaataacagggacaaaaactaaaagaaaattcctaactggaattttgcttcctaatcaaattttggaaggatgggaagagaggtggccataaaatatgttaaatagttgcacagttgtgcttctattcaaaataggtagaaaaactgcaatgctgaaaacacatctacaaataattatgaattaagtatggactaaaatttaatttggagacaatttcaacattatcaaaaagttaattcaaaggcgagtctaatatttcatcatcctcctagaggatcatctattcagtctgatttttttaaagctaattttattgttagcattgatagctaacaaataattaagcttaagtactgctaaagcaaaataaaatttcataccaatatatgcttccagttgtgcctttcatctatatattcatatgaacacaattatgacaaattatcttacaggacatcctacacaacagatttaataaacaatccagttttgtagtcaattctagaaaaaccaaaatagtttgaaataagcaagttattttacctttttctttagcatgaatgtcatcacatatgtgtagatctagatgagaaatcactaaatgatgggaggtttccttaacatcaaaatcattgaatagtttcacaattgcatcatttacatcaggagcatttgaagtttgcgttgtcttcacttgctgggcagatgcgactactgtagagctctaaaaagattcgaaactgccttatcactgccaatttaaatactggaaatttcacacaaaaatctaagtattttcagtcgaaagtcatgaaaaataaccatagtacatcttatttttcatcaataatatattttccctaaaatattttctgaattacctaagaataaaactaaaatttaaaaacggtaaaactaggctcatgcctgtaatcacaacactttgggaggccgaggcaggcgaatcatctgaggtcaggagttcaagaccagcctcgctaacatgctgaaaccccatttctactaaaaatataaaaaattagctgggcgtggtgccgcatgcctgtaatcccagctacttgggaggctgaggcaggagaatcacttgaacccgggagacagaggctgcagtgagctgagaccgtgccactgcactccagcctgggtaacagagcgagactccatctcaaaaaaacaaaaacaaaaacaaaaaaacaaacaaaaaaactgtaaaactatacacaaatcaaatatgaacccaatatatctcagtaaatatctgaagttatatttaacatatttatagcccttgttttagaaaatgtagttaactcttaaaggcagtttatttgaatattatatatattaaaaacaaaacaaatgtgggccctgtatacactgttatatatctgatatggtttggccctgtgtccccacccaaatctcatcttgaatggtagtcccacaattcccacgtgttgtgggagagacctggtgggagataattcaatcatgggggtggcttcccccatactgttctggtggtagtaaataagtctcacgagatctgatggtttatcaggggtttctgcttttgcagcttcctcattgtttctttgactgctgccatccatgtaaaatgggacttgatcctccttgcctttcaccacgattacgaggcttccccagccacatggaactgtaagtagattgccctgtctcgggtatgtctttatcagcagcgtgaaaagggactaatatgatatcctatagaaataaagcacatctttgtagaagcccctgtgatattatttagtactctaagtgctctggtgcctctcctaaaagatgtggtatgtcctttgaacttgaataactaaagaagccagaaaggagacaggatttataaataggttgtgagttcaaatatttttctccctgaagagaaatagtatagaaccctgttgatatataaaaataaatatgaacctctaatagcctaaaattattttgtatacataactataatgtaagattatctgacatatgagccacaaaactgtagatgaatttttataataattataagaccaaattttccactttaaaaattaacaatgttcaaatttagaacaagttattaactaaagataattaaagaaaatcaaagtatatgtattttgcatgtatatatatttacacatattacatctatgaagaactatgatcatactgtaaaagaactgcaaagtatacttagtaaatgagaatctcttcatgaaaatgattgcagcccaaggtaagtaaagaaacaaagtgaaatatagctgtaaaacgttaaatactatagactccagaaaactttttattaattaattgttaaactgatatcaaacactttttctcctgcttttcccattttcaaagctataacaagactgtatttatgtctatgatggtgctatttaaaatactctccggtacttctttcattatgttttctctcttatcaagataaatactgataaaaataaaaatataaacatttatctacctacaaacctttttcttaatactatggtaaagtcaggttttgggatgctatttctggaagaaaaaaaatgggccactataagctctctgcctcatgaataatcctttttttttttttttgaggcaaagtctcactctgttacccaggctggagtgtagtggcatgatctcagctcactgcaacgtccgcctgctgggttcaagtgattttcctcccaagtagctgggattataggcgtgcaccatcacgcctggctaattttttttttttttttttttttttgagacagagtctcactctgtcacccaggctggagtgtagtggcatgatctcggttcaccgcaacctctgcttcccagttcaagcgattctcctgcctcagcctccagagtagctgggactacagcgcccgccaccacgcccagctaatttttgtatttttttagtagagacagggtttcaccacgttggacaggctggtctcaaactcctgaccttgggatctgcccgccttggcctcccaaagtactgggatttcaggcgtgagccacagcgtccggcccctaattttgtattttattctattttattttttgagatggagtctcgctctgttgcccaggctggagtgcagtggcatgatctcggctcactgcaagctctgcctcccaggttcatgccattcttctgcctcagcctcccgagtagctgggagtataggcacccgccaccacgcccggctaaattttttgtgtttttagtagagacagggtttcaccgtgttagccaggatggtcttgatctcctgacctcaggtgacccacccgcctcagcctcccaaagtgcggggattacaggcgtgagccacctcgcctggccaaatctttttttttttttttagacagagtcttgctctgtcgcccaggacagggtgcagtggtgcaatctcagctcactgcaacaacctccacctcccaggtttgagagactaccctgcctcagcctcctgagtggctgggattacaggcacccaccaccatgcctggctaattttttaattttttgtacagatggggtttcaccatgttggccaggctggtcttgaacttctgacctcaaaagatccgcctgcctcagcctcccaaagtactgggattacactgcacctggcccctatgaataatgttaataactcttaattttcaaaatagtcttctttctcttttagagaagaataaaatgaagctaagcaaatacttataatagaaaacaactgcctagttgtaaagttgagcaaagaaacactgttaactaattcactttctgacacgttgtcttgggacctgaaacaatcagattaggacattctgtgtgatatctgaagtagtgacatgataactactacccaagaaagcaattctgtggtaatggttaagtatatccactataaaatattatggagcaacaaaacgtaatagctacaaagactaaagacatggaagaaacttgcatatgcccactaactacaactaggaaaaagtacatatgctggggcaaaaacctgtaagaaaatacctcaaaatactaactacaactaagaaaaagtacataggccggggcaaaaacctgtaagaaaatacctcaaaatggtagcacaggttttattagcatagtgagattacaaaattttgtccttgttactagtttcctaatatatatgtatctagttttctaatccatattccattttatataaacatatccacatattataagagctatatagtaatatcaaccttcaatctattagtctttaactacgactgccatctctgttaccaatcacaacctaagctaccaaaatcttccttgcaagtcttaacagaatagtatttatgtctatgatggtaatattgcaaaatagtctcctgtacttctttccttatactttttcagcttcaaaatgacttttcttaccctcacctcccttaaatctacttccttctgccttcccttattggctaacggtactaccaactgtcattctaaagttctgaacttttctctcttccttatcctcaacttacttaaaaacttccactggctcccaaatgcccataggaaaatgtccaaattcttcaatacattatacaacatgtttcatatacagtcactgcaaacttttgtttcaactcgggctaccagtccaggaaaactattctatgttagggcccagtggtctgtttgccaaacgtttaaaatcaggtcccccagagaattctgcagatgcctcatggatgaataatttattggtagaataatacagagtttaccttcaattctatatctgtttatttgtttttatggctacaggctctagaagaccttgttcacataaatagacagattggaaggaaagcagttttgttttagccatgtgactcgattctttcgagttacctgccaggattcacaaagtgatctactataaaaaaattactttaataatctctaatagctgacaattatttgatcttccttcacatgtgttgaaaataactaaaaatcatctggcttgcaatttccaacatgaatagcaatatttcaaattgccactctatcttgtttcccagaggagtttttacccccttcctgttcaaatccatcctagtaagactgaggatgagtaataatgtctttcatttataaagtaggattagagtcattatggaaagggaaaaccagcctgacatcttaatgcaaccatattctctggcagatcaagtttaagaaagaatacacatcaaggtggaatgtgtggaactcaatttctttaaaatataaaacttggaaaattgtaatatatcgtgaggcatttgaacctcactcctaaaaacgctactctagtaacaccaaatttcttatctttaccagaaaatatcatgatctttaaaaatactatatttctgcagattctattgtctcttctgaaatgccttttccctatgtctgcctgtgaactgctactcatttctaagacgtaattttattaacctctttgtgaaacctttccacaccctgcaagcaattaattaaaacctctctgtgtttctgtagtccctacacagaaccctttcccttacttcttcatgctaacatttatgttgaactacaatgatttggggatttgtttgttttccttttttcttttggaaacagatctcactctgttacgcaggctgaagtgcaggggtgcaatggcttgacctcctgggttcaaacaatcttcatgcttcagtctcccaagtagctaaggactgcaggtatatgccaccaccaccacacttgggtgatttttaaattttttgtagagatgggactcaatatattgcccaggctggtcctgaattattggcctctagtaaacctcctgcctcagcctcccaaagtactgggattatagacatgagcccctgtcccctacttataaagatttgtttcatatttgactcaccattattctctgaggtccttcaggccagggtcagatgatattcatttttacatcagtgtttacccctacccctgcaccttaggaaatagtaggcaggcaatagataatgccaatgtgatattcattgaaagcctaggccgggcatggtggctcacacctgtaatcccagcattttgggaggccaaggcgggcagatcacttgaggccaggagttcgggaccagcatggccaacacagcgaaactccatctctaacaaaattacaaaacaaattagctcagcgaggtggcacttgcctgtagtcccagctacgcggggggctgaggcacaaaaattgcttgaacctgggaggtggaggttgcagtgagctgagattgtgccagtgaactccaggttgggctaaagggagactgtttcaaaaaataaagcctaaatgtatgccattcccatgtacaaagctggatcaccaacaagctatatatctgagatgtataacactgtttccaaggaaatagcttcgtaggtgtataattttataatatttagttacgtttttactagaggtagatataaaaattcatttatactttgcataaaattatttaaaatattatccattataactatcactgtctcttctataaagaccttgatgtactggtactcagaacttactactgggaaagaccagaaaaacttttcctctccataccaactaataatgctccatacaaactaataatcacttttaagaaagtgataaatagctcattatgcttgtccctgttcttgccccagccatcagacaactccaacagaagttttgtgttcaatttcagcaattccttatggctttgattctctgcacagttaactctcacacgtcctctcttgcctataattacccaggttttttcctcatttgcttttactttagtagttttaaaactgtactcttttaacttcctaaacagaggtattaaaacatcgaatacttttatgtcatcattagctttagtgcctaatacagagctctaaacagaataaacactaacagatatgatagctactacttatataaaattacatagaagatatctagataaagaagattcttgtactcaaaacctcacaatctgtctcttaaagaaaataccaacaattccttctaatttttaaactattttcatgtaaagtaagtatttttcctgttaactttatagcttacctgtgtaggttcaggagccatactcttcctttgttctgttgatttttctattgcttcactaagagactttgcatattgtaccatagctttcaactgggaatcagtcaaaacccataataagtcatccaatattagaactaactttgttgctatgacattgcagtcctttaactgtaggaaaaaaaaatgttttataaaattaagccaagatataaaccttataatacgcttgtattaaaaaatgttttcaaaacgtttttgaatagaaatatggattcttccttcacacaagaagtatttactggccgggcacggtggctcatgcctgcaatcccagcactctgggaggccaaggcaggtggatcacccgaggtcaggaggtgaagaccagcctggccaacatggtagaaaccctgtcgctactaaaaatacaaaaattagccaggtgtggtggcggacacctgtgtaatcccagctacttgggaggtggaggcaggagaattgcttggcccaggaggcagaggttgcagtgagcagagatagtgccattgcactccagcctgggtgacagagagaaactctgtctcaaaaaaaaaaaaagtagtagtatttactgagttcctataatatgaaaggaatatcacctagtactagagatgcagtggtaacaaaagacagacaaatccttgtaccttacaagttatatagcacttatataacttaattttgcatttatagctgataaattatataattacttgtattaattcaaagattcaatagaagaaatgaaattataagacagtaaatgttcaacaagtatttggcaactgagaaatatattcaatttaccaaaaataaaaatgtttaggccaggcatcgtggctcacacctataataccagcactttgggaggtcaagacagaaggactgcttgaagccaggagttcatgaccagcctggacaacaaagcgagaccctgtctctacaaaaaaaaaataaaaataagctaggcatggtggtgcatgcctgtagtctcagctacttgggaggctaaggcaggaggatcccttgagcccaggagttcgaggctgcagtgagctaggattgtcccactgcactccagcctgggcaacagagcaagaccccaactccaaaaataaaaataaaaataaggcagaggcaggaggatcacatgactccaggagctcaagaccagtctgagcaatataataagacctcatctctacaagtaacttaaaaaattattcaggcatagtgggcgtgcctattgtcccagctacttgagaagctgaagtgggacaatcactttagcctgggaggtcaaggtttcagtgagccttgatcatgccactgtaatcaagcctgggcaatatagtgagatctcatctcaaaaaaaataaaataagataaaaataaaaagaacaacaaaaaacctttgaaaaatctattaaacctaagactgaagaacattataccagttttctataaatattatctgagtaactatacctccctttattttgcattattttaatatgccactggtaatatgccaatatttcacctaagacattgtttaaaatttcctatagttaactaatagttaacacacaaatcaaaaagtcaaatccaacagttaacacatgaatcaaaaatgtaatcttgttgactcacccttcttttaagtgtgactctgatttttgattggttggttattaatcgaacaggagcacacataatttcaagatgtgaactttgggtggcatctgcctctattcttatcatctgccaatttatttctttaaaagtcaaaacctaaggagaacacagagattaacttcacttactcatgcaaaacagaatgagaaaaatgtagatttttaaaaacaaagcaaatgtatattctcagttaattttcacatgacattttagatatattcaccatgtttttatttttgtaaattgcattattccatcaaattcaattacacctcttcatattcatattcatcatatgtaaagctgttaatacttttaatctaagtaattcagttaatgtaaagctcaaatgcatgaaatcacgttaccaagaaacaaacaacatattttagtttggggaatttaaaaattcaattctgagtagctgagaagttaaaatagggctttaaatggaaagatttactagagtaaagacattaaaatgtgcacattttataaatgaatgattaagagtaatacagagagctgggtgcaatggttcaggcctgtaatctcagagcactatgggaggacaaggcaggtggatagcttgagcccaggagtatgagaccagcctgggcaacatggcaaaaccctgtctctaccaaaaatacaaaaattaggcaggcgcagtagtacatgctgttagtcccagctactcaagatgctgaggtgggaggatcacctgagcccagggaggtcaaggctgcagtgagccgtgattgcgccactgcactccagcctgagcaacagagtgagaccctgtctccccgcaccctccccaaaaaaagtaatacagagaaaagcaaagttaaaaggcaaccatgagatgtgatttttttaatcgtcctcttttacttgtcactaaatgaaacatttaaaaaagaaagaaaaaaatgttacctctcctctctgtggatcctgaatacgagtaaatctcaaatctccatgttcccagtgtgcatttacactatagatccgaagctgagaaagttcaaatgatgcattgaaggcttttgctccaattctgatgactatagaatttacagaaacagaaattccctcaactactttttcagcaaagccgtattcactggaaaaacaaagcaaaacaaaatacactaatgacaaaactaatttttaaaaattctattaatatttgcacatttctggttggggatggtggctcatacctgtactcccagcactttgggaggctgaggcaggcagatcacttgaggccaggagttcaagcccagcctggccaacacagtgaaaccccatctctactaaaaaaaaaaacacaaaaaattagccaggcacagtggcacatgcctgtaatttcagctacttgggaggctgagggacgagaatcacctgaacccaggaggtggaggttgcggttagctcagattgcaacactgcactccagcctgggtgacagagcaagactctgtctaaaaatatagacagatagatagatagacagacagacacatagatacatagatacatagatacatagataatttgcacgtcaccattttattattttttttttccctaagagtctcaactctgtcgcccaggctggagtgcagtggcatgatctcagctcactgcaacctctacctcccgggttccagcaattcttctgcctcagcctccggagtggctgggattacaggcatgcaccaccatacctggctaattttttgtatttttagtagagatcaggtttcaccatattggccaggctggtctcaaactcctgtcctcagatgatctgcccaccttggcctcccaaagtgatgggattacaggcgtgagccaccaggcccagtttattcatttttatattgaaaaaataaatgttttttattaaaacaataatctaagctgggcctggtggctcacgcctgtaatctcagcactttgggaggccaaggcaggaggatctcttgaacctggagtttgaaactagcctgggcaatatagcaagatccctgtctccacaaaatattttaagaggccacacatggtagctcatgcctgtaatcccagcactttgggaggccacttgaacctaggagttcaagaccagcctggacaacacagacagatctcgtatccgtagaaaatttaaaaattagctgagcatggtaacacttgcctgtggtcccagatactcacaaggctgcagtgggaggatctcttgagcccaggaggcagaggttgcagtgagctgagatgaaaccactgcactctagcctgggcaacagggcgagaccttgtctcaaaattaattaactaattgattaattaattaattagctggacatggtggtgcatgtctgtggtcccagctacttgggaagctgaggtgggaggatcacttgaggccaggaggttgacgctgcagtgagctgtgatcatgccactgcagtccagcctgggtgacagagagagatcacatttcaaaaaaaaaaacaggaaaacaaacctcagacacaacaatctagtctagttacatataaattattaaaaaaaaaaaaatgctattctcagccaggcatggtgacagtggctgtcacctataatcctagcactgtgggaggccaaggcaggtggatcactttagcccaggagttccagaccagcctgaccaacaaggagaaatcctgtctctattaaaaatacaaaaaagttaactgggcatggtggcgcatgcctgtagtcccagctactcgggaggctgagctgagaggatcgcttcagtatgggaggtggaggttgcagtgagctgagatggcaccactgcactccagcctgggcaacagagtgagaccttgtctcaaaaaataaaaataaaaaaataattttttaaaaaaacgctcttctcattctctaaaccttttctggttctcagggctgcaaaaaaatttttttaatactcttcttaaaatgtaaaagactttttggctgggcacagtagctcacagctataatccaagcactttgagaggcaaagggaggaggattgcttgagcccaggagttaaaatcagcctaggcaacacatggagaccaccatctctacaaaaaatacaaaaaactagccaggtatggtggcttgcacctgtagtcccaactacttgggaggctgaggtgggaggatcgattgagcctgggaggtcaaggctgcagtgagccaagatcatgccactgcattccagcctgggcaacagagtgagacccaaaaatacatattcacattctatttttttttttttttactctgaacaccactcaatgaatgtattcattttattgatatccattccagacctactgaatcagaaattcaagaaaaggagcttcagagactttgtagatttaataagcactctaaatgactgttacaatcaggcaagtctgaaaaaatgctgaaatagattaaccatactgccatatgtcaaaatatgaggatgatttaaatagtttaaatcatcacatgattagaaagccaaaattataaagcttatgatactataaaaacaagaattaggaagaacactatcaactatactaagcacacaaggacaaaatgattcattttagttctttccgactctagccaacctaaaggccaacaactattctatgaaaactgaaatcataatctaacctgtaaaatctgaagttgcaggatgatgctacattacaaagaagttaacatgaaagctcttttcccagtcactaatatctgtagtccaaatataaactgcacatctgataaacctggcctttagtcaactcttagaagtggaacgaatcaccattagattcccatggcatgcactgtaggtattctcatggcatgcactaacataaaggtggctcaacctttgtaaaacaggagtaagtgagtgtgtgtctgtgtacacacacgaatgcattcatcctcaagaaaagttttatcaattgttttacataacacctagaatactatacatgttcagagctgctattttacgcaatatgaggaggcattaatcacattaaaaatctatgtcaacaattaatgtgaacgcaaaaataatgcagaaatcctgttgtagaaaaatcatgtatagttctagatttaaatttcactgagtgcaaaaaagcagacaacatatttttaaaaatttaataacttctaacttttcaaaaagactttatgaaatgatccccatacttctgctgtattagcatctgattttcatctatcaaaatacaacctgtggaaagcaaaaacattttaaacttaatgaattttagagtaacccaaaaggtctgtaatttaaggcatcaacttaactctttgtttttgagacagagtctctctccatcacccaggctgcagtgcagtggcatgagctcagctcactgcagccttgacctcccgggttcaagcaattctcctgcctgggcctcctcagtagctgggaatacaggcgtataccaccgcacccagtttttgtatttttggtagagacggggtttcaccatgttggtcaagctggtggcaaactcctgacctcaggtgatccgcccacctcagcctcccaaagtgctggtattacaggcgtgggccactacaccgagcccaacttaactctttttttttttttttttgagacggagtctcgctctgtcaccaaggctggagtgcaatggcgcgatcttggctcactataacctccgcctcccgggttcaagcaattctcctgcctcagcctcccaagtaactgggattaaaggtgcatggcgccatgcccagctaaagttttttgtattttagtagagacagggtttcaccgttttgcccaggctggtctcaaacacctgagtccagggaatccacccgcctcggcctcccaaagtgctaggattacaggcatgagccaccgctcccagcctcccaacttaactcttaagagtcataaaagttccactgatgcacagaaaatgatatgcagagaaactgatcagaggctatctgatttatataatgcctaaattcttctgcttccattttctgttgctgctctgccattagttaatcactattatttaataatagcaaggaaagcaagatgaataaagaaagttaaaagtcaaatctgcaactttgcaatgtatataactaaaattgtaaaatgtttgatgggagagctgactgaaatagaggccatttgaggttaaggctttttttttttttttttttaatgtcctgttattggcagtcatgcagattaatggaagtagcttacctttgtcctgaagcagttgcaattggtgatgggccattagggcttcttggttcttcacatgtactcatttccattattactttatccagggactaataaaaacgttaaaatataaacaattagattatttattctacgtatattattaaagtattatttaagattattttctctttcatttttctttaggaagaaagtaaaaagtgagcagagtcatttaagtgcctctctacaggtctaaaaagacaaatgccaaaaaagaacacaaagcactcaatcagttctcaaggcatttattatctggtggaaaagctatgtgtattacaggtgttggggggtggggaattaagacatagccattaactactaaaatcatcagatttcatgaaaacagaatctctactcccagatatattcattgatgaaattatatattaataagtaggactgaactaccccaaaaagcttatcacaatctaagatctgagctatgagacacaaaactatgggaaatatgaaataagcaggaaatgtgaaaaaaaataaacactcccataatggaaaaggttctttctcagggtaatatttttctccttgaagaaagatctaatgtccttaatcgccatcactaacactactccagtcattcttcattctctatttcatatatagcatttattattatctgaaactgtcttgttttattcatgttcttgatcattgtattttttaaatgaacgaacaaatgatcaattttcttcaactttccttaaaaagcaaagtatattaaagaacatatttcataatttactagatcactaaaaggagaaacaaagacagtctggatcaaatgttactgaaagaataatcccatagtacatcaacaaagagttaaatgatgcaataaaatactataccaatttagaacacagtattctagacctgaaaaactttaaagatgctcctactttaaggttaaagcttctcatttaaaggatgaaaaacctgagtcctatcaaaataaaatgaaacctaactggtgaaaaatccagactatatttccatgaaacaaaagattactatgaacagagtagctagataatgtatatatataaatgtttatttctaaagtggtttcagaactcaccaaacagatgggatgtgttttcagttttgtccatgggatctacaaatgaaaaatttttaatttaagatcaatcattaagaagaaaataatgtaaacagtaatcaatacaggtgttatattaatataggacagacacaccaaattatataaaatcacttttcttaaactacaaaataaactaagcaactcactcatacttttgaaaccagatgtacccattttatttaagaaattattactagctatatctcctcagacatcttttgaatagaaattgtaagttctttttttcttttttttttttttttttgagacagagtctctttctgttgcccagactggagtgcagtggcacgatatcggctcactgcaacctccacctcctgggttcaagcaattctcgtgcctcagcctcccagtagctgagattacaatcaagtgccaccacgcccggctaatttttgtatttttagtagagacagtgttttgatatggtggctagactggtctctaactcctggcctcaaatgatccacccaactcggcctctcaaggtgctgggattacaggcacgcaccaccatgcctggccaatttcaggttcttttaagtatctttttttttttaacaatccttaaaacaaatcttaatatcataatttaaatgaagagcttaacaacctgtttaatcctaaaattctgagcaatcattttgtaaatattcaagacaaatacaaaagttcggccattaatataaaatgtaggaaacatcaaatacataatgttgatataccctgtactaaaaatgccaagttttgcctccaaaaggctcttagatctaataaataaattcagtaaggtttaggttacaaaatcaacgtacacaaattagtagcactgctacaaaccaacaaaaaccacgctgataatcaaatcaggaactcaatcccttttacaataactactgctactacaaaaaaaaaaaaaaaaaaaaaaaaaaaaatgtaggaatatacctaaccaaggagttgaaagatctccacatggagaactacaaaacactgtggaaaatcatagatgacataagcaaatggaaatatatcccatactcgtggactggaagaatctatactgtgaaaatgaccatactgcccaaagcaatctacaaattcaacacaattcttctcaaagtactaacatcatttttcacagaattagaaaaaacaatcctaaacttcatatggaaccaaaaaagaacccaaatagccaaagcaatcctaagcaaaaagaacaaaactggaggcatcacattacccaacttcaaattatgcaagtctatagtaaccaaaacagcatggaacaggtgtaaaaataggcacatggaccaatggaacagaataaagtattctgtttctgttccattgaacagaatacacaggccaatggaacagaatagagaaccaagaaataaagccaaatactaacaatcaactgatctttgacaaagcatacaaaaacacaaactggagaaaggacaccatattcaataaatggtgctggaaaaagtggatagccacatgtagaagaatgaaattggatccctatctcttactgtatacaaaaattaactcaagataaatgaaagttttaaatctaagatctgaaaccataaaaactgtggaagaaaacctaggaaaaactcttctgaacgttggcctaggcaaagaatttatgactgagaccccaaaagcaaatgcaacaaaaataaatgagacctaattaaactaaaacgcttctacacaacaaaagaaataatcatctgagtaaactgacaacctacggattgtcaatattcacaaactatgcatctgacaaagaaaatatgcacaaattatgtgtctgacaaaggactaatattcagaatctacaaggaactcaaacaaatcagcaagaaaaaaaacacgcccattaaaaagtgagcaaggacatgaacagacattttgcaaaagaagatatacaaatggccaacaaccacatgaaaaaatgctcaaaatcattaatcataagggaaatgcaaattaaaaacacattgagacaccacctttttccagccagaatggccattactaaaaagttgaaaaacaatcgatgttggcatggaagtgatgaaaaaggaatgcttatacactgctggtaggaatataagttagtacaacctcaatagaaaacagtatagaaatttctcaaagaactaaaagtagatctaccattcgatccagcaatcccactaccgagtgggtacctatccaaaggaagagaagtcactatatgaaaaagacactggtcctcatttcaaacatgactctattaaaaaaaaaaaaagacacctggacacatatgtctattgcaacacaatgcacaattgcaaagatatggaatcaatctaagtgcccatcaacctatgagtggttacagaaaatgtggtacataaataccatggaatactactcagccataaaaaaagagcaaaataatgtcttttgcagcaacttgaaaagaactggaggccattattctaagtgaagtaacatgaattgaaaaccaaataccacatgttcttttaagtgtgaggtgaactatgggtatgcaaaggcatacagagtggcataatggactttgaagactcagaaggtgggtaggggtaggagagggatgagggatgaaactacttcctgagtacaatatacactactcagctgacagatgcactaaaatcccagactttaccactatacaattcactcatgtaaacaaaaaccacttgtatctctaaagctattgaaataaaaaaaaatttactgaaagtgtcaagtctttgtagatatttaggtttccaaaggatagaacaaaaattaaaagtgaccatcaaaggatataggaacttttctataatcttttcttaggagcccaaattttagttttaggaaacaatcagcatgcagtatttcaac

SEQ ID NO: 1159 - DNA, 1064 bp, Homo sapiens
tggttgagggtaagaataccaaaaaatatcaattttctgtagcattaccagccattaggcttaattaaacaattattagaacagtatcagtggaggctttatgattctgtacagtttttgaagactttgttttgttttctaggttgctgaagcagaagattgttataatacagctctccgtctgtgtcccacccatgcagactctctgaataacctagccaatatcaaacgagaacagggaaacattgaagaggcagttcgcttgtatcgtaaagcattagaagtatgtgagggtggtgtagctgggcatttagcatgatagtagagggaaagcagttaagtttaccatcatccacctcttttgtaaaaatagtggttgaatcatttacaagaggattattcattgaagtaacaattgagtacctaaggtatgatgtgaggccctatgtgacattccagaaaatccctgcattcagagttcattattctgtggataagatctgtacaaaaaaattaaacattaacccacagttcaagagaagttacttataagtatataatcttagtgcctgatggctgtatggtagtggttagtagatgtggtaggagtttagcagagagagatttcagtggtgttggagtggtcaggataaactaagaggagaagaggtgtacctcattatgtttgaaacaagaagaggtataaaatagaggaagaggtagaatttgagaatgaatagacttggaaaaagtagagacaaatttaggggtttaaatgtacttgagcaaagttcttaaggttgtggtgaattattactgctgctttagcaatttttttaacctcagttctgatcttgactctttataggtcttcccagagtttgctgctgcccattcaaatttagcaagtgtactgcagcagcagggaaaactgcaggaagctctgatgcattataaggaggctattcggtaagagacactaacagccttatttttaaaattatttttaattttaaaatgtttgacattcggcacattgcagatgctaaaatggctttaaataa

SEQ ID NO: 1160 - DNA, 3129 bp, Homo sapiens
cccctcattttttgacaatcattctttttgcggtagtaacgaaatcaagcagttttcatttggctttttggtagttgaagttaatttgtcaatttcctgctagtcttctattacgtacacatttttctggttagctgacaaatcagaatgctaatgatggtggggaaaagaagactggcaaattttacttctgtgggttttaccaaaatcataattggttgatttttcctttagaccttccaggataaaggattttttatttttaataatattttcttcattctaaataagaaagtgaaatgtacaaaacagtggaaagaataaaataacttaaatgtgcctgtcatggggccttacactcaatcagtatgttaacatttttaaagaaaaataaatgcccataatctcatcaccaaacacatgtagggaatttttttggcaaagattttatatatttgtagttatgctctctataaattttgcatcaagcttttttcatttcacattttcataaataatttctcatgccgttataaactcttcataaacataattttaattggctacgtaattgttttttaggagtacatttggctgcaagtgcctgaaaacctgggaagaaacagcttaagggtttttgtttgtttttttcatggaagaagacattgagacaaggggataaggggtcattgagaccatcagagaacctcctcctgcagctctgtttttcttagtgatggtggctgcaagccaagcacagggctctcccagagaaaacagggaatcactcccatctgcagactaagccatgtgatcaccctagctcaaaaatatctgggaaggtgggctgataactttccagcctttgtagtggaggaatatgggtttcttaaaataaaatgacctgaattagaattactgtgtcaaagagcagttgatttttttccccgaaattccagtctgattgcttatttggtgaaaagcaggatttaaaaacctgtgctccatttactaccatctcatttggcactggaaacacaaatgtacaactagttataaaagtaggatcaagtccaaaacctgtggctatcagtttcggggaggcagctgtcaatgcaagataaggaaaaaattcctcaatatttagagctgccccagtttggaattaactacttcatgggatggtgagcaacctttcccaagatgcagcgactgaatagatacttggtatataggcagaagaggtaatttacgcatttggtaaagtagaccgggtgacctgtaccacctaggcatctccatgattttaaaattaggatacatttgctaaaatatttccccaagcacccaggatatcctttgcatggtggaaccttgttctgatgttgcttcagatcaaacatagtagcctgaaatgtggctgtagtagagtagttgcctgagatgggaagaattcacctcccaggctcctgactccagggccatggaaaagctctatcttgggtttgagaccagccattacctgggtcaggcccacataccagccccatccaaggttacatatctgatttcctcactgcctgttaacatgactttattatttttcctgatgccatggatttcttcttttgtatcaacaaaatgtgcatgttccttatgtaaaaggtggtataagttctatctttgacattacccaattataaaatgcagtaaacataaaaacaattttctttttgatttatttacaaaagtggtctttccaaaacagttttactagtttaactcattttatctgaactccagcttaaagctatgaagtcatgtgtgataaataaacatgcatctgagtttatgtaattcagccaagaaatattttttgaacattttctatgttatagatatatttgtggatgctgagaatgttcatggtaaatacaagacagtctctgccctcacggagcttgcattctggtgggagactagggaagaataatttatgaataaactattgaatatatactatgtttgtatagtttgtagtacagagacttggttgtgctggggagggggataccttcatagaatgttcaagaaaaaccttactaataagctagtgttggagctgtgataaaaaacaaagagtgagccatgtggatatctgggggaaacacacttctggtggaaggaacagcaagtgctggcctgagctgagatcatacttagtgtgttcaaaaagcaaaaggaaagcctagtgtggcaggtggggagtgggtgaaggagagtggtaggtgatgtgaccaaagaggtggtggctggggctggattatgaaggcatctatataccgtggtaaggatgttggcctttacttgacatgagatcagaatccagtggaagatttggagcacaagaattgcacaatctgacctattttttaaaaagattactctggctgatgtggtgagctgagttagtaaggaagtgggcaagcgtggaagcagggagactagttgggaggatattgtggtaattcagagggaaaagagatacatgtgggccaagctagcagcagaggagatggggaatcctggattgatgttgatagtatagttcaggggatttttctcatccagtagatctaagtggaatgtgagagagagaaaaaaaagtccagaatgtgccaaaggttttgaggtaagcaactagaaggatggagtttcactggaatgaaatggggatcaccatgggaaggcctgctgtgaagggaaaataggaattcaattctggacatgttaagttcaatttttggagatgttggtctgatacctaggtggaagtgttgagtggtcagtgtcttagcctgttagtgctgctgtaacaaaatgccatagactgggtggcttatatacaacagaaacttatttctcatagttttggaggcttggaagtccaagaccaaggcattagtaggtttggtgtctggcaagggcctgtttcctggttcatagatggaaccttctatatatatatgttcacatggtggaaggggcaaggcagctctctgggaccttttttttttttttgtctgaaagaattccaatattatgagcatgtaatataaacaaaggtag

SEQ ID NO: 1161 - DNA, 1231 bp, Homo sapiens
aatgaaatgccaagattttcatgcattgtaaatccccatataaactaaactatatgaactaattatagaatactatctatctatttatctatctatctatgtagtcatttctagattctctattatctcctattgtttcttcattgatcccagtataattattgtgctatagtaataacacctgtatacctggtggtgggcaattctacacttaccattcagaattgtcccatttccacatagtttttgtttgtgaatgaatacaaataagaatggttttctacttaatacttgcctattagtgccaacatcagcttgactctactaaaaggcacacaagtgtatctttccgtctctgtggtgaagcttctcttttgggatgggctatacttacatttttttttttttaattaggaggaatatttccaaatgtccttcagcaagccagtatggtaccttatcagtgccccaatgcaaagctccaaagcaaacaaaggaaaactctactgtaagtgctcaaataaccatttcttatacttctgatacaatgaaaaaaaaaatttcttcaaaatttttcagttgcatgagaaaataataattcaacattgtgcaaaagaagattatattagaatattttacaaaagtcattctcatacgttttatacttacagatatattatatttttaaaacattattttaaaggagaattaacatcaattatactaatatgttctgtgtaaaacaacttagcaccacttttttaaaaaggcattaattcaataactactatgctggttgaaagaaaaagcaaaatttgagtttcacataacattggtctcattttcatcctgaattttaaacaaaagtctataaacaagattagagaaatcgttttataaatttgaatgttgagatttatataaatatgccattataagagtttgatacaaagtacttaatattttctattgatatgttccaaagagaacctcacaaagaatattttttctgtatggcaggaaaaatgctaaaatcccttaattgcaaatgtgaatttcccagctgacattaattttggtttataaggatgcacattaaaagcagtgttgcctaagctcctaaatataaacttagagtaagagtttagtaataagtatcagttatagaggctatgtgtataggttgcattttagaattccttggtgtttttagtcatgactaatgaacagc

SEQ ID NO: 1162 - DNA, 5044 bp, Homo sapiens
ataacccaaaaggccataaatataaggaccacataaaaatttaagtcaaaagacaaacacccgggtgaggtggctcatgcctgtaatcccagcactttgggaggctgaggtgggtggatcgcctgaggtcaggagttcgagaccagcctggccaacatggtgaaaccccgtctctaccaaaaatacaaaaattagctgggagtcgcagcgggcatctgtaatcccagctactccagaggctgaggcaggagacttgcttgcactcgggaagcgaaggctgcagtgagccaagatcgtgccactgcactccagcctgggcaacagacagagcgagactctaactcaaaaaaaaaaaaaaaaaagacaaacacattaagaaaaaaactgggggccaggcacgacggctcctgcgtgtaatcccagtactttggcaggcagaagtaggaggatcacttgagaccaggagttcaagacaagccggggcaatatagtgggaccccatctctaaaaaaaatgttttttaattagccaggcatggtggcacatgctccttgggaggaagaggtcacagccacttgggaggatgaggcaggagtatcacttgagtccaggaggtcaggcctgcagcgagccaggatcgcacaactgcactccagcccggatgacaaagcaagaccctgcctctaaaataaaatttagtgccgtggctcacgcctgtaatcacagcactttgggaggtgggggcgggcagatcccgaggtcaagagtttgagactagcctggccaacatggcaaaaccctgtctctactaaaaatacaaaaaaaaacaaaaattagccagaaagccaggagcagtggctcacacctgtaatgccaacactttgggaggctgaggcggatggatcatgaggtcaggagttcaagaccagcctgatcaacatggtgaaattccatctctactaaaaatacaaaaattagccgggcgtggtgacgggtgcctgtagtcccagctactagggaggctgaggcaggagaaatgcttcaacctgggagacggaggttgcagtgagccaagattgtaccactgcactccagcctgggcgacggagcgagactccatctcaaaataaataaataaataaataaaaataaatgagccgggcatggtggcgcgtgcctgtaatcccggctacttgtgaggctgaggcgagaggactgcttaacctcgggaggcggaggttacagtaaggtgagatggcgccactgcactccagcctgggcaacagagtcagactctgtctcaattttttttttttttttgagatggagttttgctctgttgccgaggctggagtgcagtggtgcgatcgcggctcactgcaagctccgcttcctgggttcacggcattctcctgcctcagcttcccaagtagctgggactacaggcgcccgccaccatgcccagataattttttgtatttttagtagagatggggtttcaccgtgttagccaggatggtctcgatctcctgacctcatgatccgcccgcctcggcctcccacagtgctgggattacaggcgtgagccaccgtgcctggcccgacactgtctcaatttttaaaagttatttaaaagggctagcgcagaggttacggtgagccaagatcacgccactgcactccagcctgggcaccaagtgcaaaactccatctcaaaaaaaaaaaaaaaaaaaagaaaaaggccattggttcaagagaaaaatggccattcacaaaaacaagaaacatcaatggctttacgtcctagtaaaagatgttttaccacactcataactaaggaaatgcactttaaaacgagatagcattttcactaccagattgacagatgttttaaatactgtcattctagcactggtgaaggtgtgagaaactgttggcaatgccgtctgttatcttggggaaactcagcaacaacctaaatgtccgccatgagagggttacataaattacaaaacatcctcgctatggaataccagagctctgtggcgacaggaaacaaaccccagaatataagtggaaaatgcaaggtacggaagattacacacggttccttcccagtttacctttgtttcccttttttttgtgtgtgtgtgtgagacggagttttcgctcttgttgccaggctggagtgcagtggcgccatctcggcacaccacaacctccacctcccagattcaagcgattctcctgcctcagcctcctaagtagctgggattacaggcatgcgccaccacgcccggctagttttgtatttttcgtagagacagggtttctccatgttggtcaggctggtctcaaactcctaacctcaggtgatccacccgcctcagcctgccaaagtgctgggattacaggcgtgagccaccgcgcctggcgagaagattcttaagtacatgaacattctgaacagaaagacctgtattccctcacaaatgtctgagttcttagctctggcattctcaacactcactgtttcttgaggtttcctgtgttccagaacctggtctaatcgttctctactatgatatactgatacttcattcatcaggaaacataactccttgaacataaagaaaaagaacaaaaagcgaaagggcacctcggaatagtcaaaatatgggcctgaagccctcaccctgagctttgctcatggaagactactggccccatatgaaatccatctcattctaacaatttgatgctaacaagtttcccagccacatctgcaaactaggaaaggagagaacagggctccagacagacctgcaagttaaggccacagtaagagaggccaaaaatataaacactcacaatgcagttttgatgtggggacacttcatagacgaaggattcttcacatttcaatggccctacgggagcctacatattaaaacagaagaccaaacattaacacccgtaataatgaccctgaaaacatccaagagaggttcagtcatgggccatcaaatgatggagtgttctagaaagacttctcatcataatggttaaaatgaaatgttttaaagtcagcctcgtggaaaattcgcttgaacattccattgcctgacaaatgctgaaatactggcaagtgtgaactaacatggcaatgtgctgtcttaatttctccttcgaggtgcatatcactaacccgacacacatagttacattagaaggacccacgtccttctgtcttcttctcagcagcattgctgaatagcctcctgctcttaatatggcatttaatttagctatctcaaaattaatttcttttatatgtgtgtgtgtatatatatatatatatatatatttttttttttgagacactgtcactctgtcacccagactgtagtgcagtggcgtgatcacagctcactgcagcctcgacttctcaaggcttaagggagcctcccacttcagcctcttgggtagctgggaccacaggcacacccagctaattggaaaaaaaaaaaaaagggttttttggtagagatgggggtctctctaggttgcccaggctggtctcaaactcctaaactcacaggatcctcccgccgcagcccccaaagtgctgggattacaagcatgagctaccaggcctggccaattttttaccttctagccacatttcttaattatatggctatgaagtaactgagccattccttttaaaaccaatgattcagctacatgtcctttcaatctacccaatctacaggaattcacctggttaaaaagccaatggcagggctgggaacggtggcgcacacctgtaatcccagcactttgggaggccgaggcaggcagatcacaaggtcagaagttcaagaccagcctggccaacatggtgaaactctacctcaactaaaaatacaaaaattagccgggcacggtagtgcatgcctgtagccccagctacttgggaggctgaggcaggagaactgcttgaacccgggaggtggagattgcagtgagccgagttcgtgccactgcactccagcctgggaaacagagcaagactccatcttgaaaaaaacaaaaaaaaaacaaaaaccaaaacaaaaacaaaaaaaacacaggtggcagtaatactcccgcaagtagatactgtttctccaagctacagcttttatggtaattcctagtggttttagcagaaataaccagccacaccacaaataaactccctgaaatctattttgttaaatgctgtggaactacagggaagccactttgtggactaagagcagcttcctagtagaaggcaggtcttcagtaggactaagcaggacggtggtaagaaaagttctagctggctacacttgaggcaccaaaaacgccatccatgaacattctctggctttgaacccaaaagcactttttacttcatttgagtatgaatggatacattttcaatcgctatcaagattctttgtcaggcccgacgtggtagctcatgtctgtaatcccagcactttgggaggccaaagcaggcagatcaaaaggtcaaaagattgagaccatcttgcccaacacggtgaaacctcgtctctactaaaaatacaaaaattggctggccatggtggcatgcacctgtagtcccagctactcaggaggctgaggcaggagaactgcctgaattcaggaggcggaagttgcagtgagctgaggtcatgccactgcacttcagcctggcgacagaaagaatctgtctcaaaaaaaaaaaaaaaaaaaaaaaaaaaaaaaaaagatatgtcagcattttgagacaagcaagtatcacaggcctcagtaacagcctctttcatggaactcacctttgtcacatggtatttactgacatggggggcaggagtaaatgtttattttcccacagttttcttatcaacctgacacccccatccccaccccgcaagctgcattccctctcttcctgccaaggggtagcaaaatacttggagattcctcttttgtcttagcttaggcc

SEQ ID NO: 1163 - DNA, 14436 bp, Homo sapiens
aaaaggagaaaattgtcatcaaaggatattccagattcttgacagcattctcgtcatctctgaggacatcaccatcatctcaggtgagcaccaggtggagtgcctctgggtgactggccggtttggagcagggagggaggcttagagtctcatcctccagcagcgagtgaggcggaggctccagcgtccctcccgggcgggttttctggtggatggaggagtgactcggggtcctctacgtggtgccagctgtttggctttctggacgttgtaggaaagggtttcccccgcctgcgtccccctgaccttgagctccaccagcccctgccagctgggctccagaaggctggagtgctgtggcagggatgacgtctcacttctgttatgtctctgtgccctgtgctctcccaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcaggtgaggccagggcagcctccccccaaaagcagaggagctctggagtctagggctggtgggcagggccagccctatggagccacagggtgtcgggtgtggggtactgagcaccactgctcccagcacggtggaacaggctcttggctgtggaccaaggtcctcatccctgctgtgctgtccctggctggcagcaggagcccaggcagaaacatgaggctgcggttaaaccgagcaatgccacgagcatcagctgtggctccctttgtggcgctgtagggtccctgggtggcaccagccctgctcagcaccactgtggccctgcccccagatcctgagccgctatgacatcgccctggtccaggaggtcagagacagccacctgactgccgtggggaagctgctggacaacctcaatcagtgggtgacagtggcagggtcataggaaggtgacatctcgtccacggcacagcctcacttcacttgggccccaagggtggggacctgggcacagcctcgctatcggcagccagaggggtcccctatggcccccgccactgggaccttttgtttcttcaatccagggatgcaccagacacctatcactacgtggtcagtgagccactgggacggaacagctataaggagcgctacctgttcgtgtacaggtgggtggtctagaaagccaggaagcccctccctcacctgggagggccccaacagagcagggaagtagtttgtcctattagtttgtcctatggcaagaacctgaggcttcagagcagggtccagggtggagtgaaaacaccccaaggtcccggaccaatgggttgagcaggtgcctggctcccccgccctcctgtcgcctgggtcccggaccaatgggttgagcaggtgcctggctcccccgccctcctgtcgcctgggtcccggaccaatgggttgagcaggtgcctggctcccccgccctcctgtcgcctgggtcccggaccaatgggttgagcaggtgcctggctcccccgccctcctgtcgcctgggacgcgacgcctgcctcctgggaagcaggagtggggcagcttccagcctggggtcacctcctcctgcccggccttcccgcaggcctgaccaggtgtctgcggtggacagctactactacgatgatggctgcgagccctgcgggaacgacaccttcaaccgagagccagccattgtcaggttcttctcccggttcacaggtgggtgctgcctgggccagggtggggctcggcttggcgcttatggcctccaccccctcctagggaacctggaatgcctgtgtcacacactgccctcccagtccctggggcttgggttttccattcaagtcatttggaaaatatccaccccccggggggactgtcatgatacatagttccagctgacatggtgactgaacctgcccccagggagtgtgcctcacacgacgtggctgtctccacagaggtcagggagtttgccattgttcccctgcatgcggccccgggggacgcagtagccgagatcgacgctctctatgacgtctacctggatgtccaagagaaatggggcttggaggtgaggccctcccaggggcagtgggcaccagcggcctccgcatgtcccagggccacaggcagcgtttcctggtaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggtgagcagggcctcgcgcttagggcagactgagggcacctccaagggcagccgtgactcataggtcgggcttcagaagcctcaaagcctttgaacactcacccaactgagcttcagttgatccactacagggaacagaataacaagagccacgatttttaggttttttcggaaaagcacatctggggataagaggagaggcagacacctaggctgtcatgtggtttccacattgaggggcacagaccagggtgtgcagttttgggcacccacagacctgcactggcaggtcccagggctcttagtttagttcctgcgggtgctgagccaggcccatgtgtgaaaggggaacctactttctcttcccaacacccatcaggatcgtggttgcagggatgctgctccgaggcgccgttgttcccgactcggctcttccctttaacttccaggctgcctatggcctgagtgaccaactggtatgtgtcctcccttgcacagccacatgaggatgggacacaggagctcaggtaggctcagcccagaccctgtgcccacttgcctgcaggcccaagccatcagtgaccactatccagtggaggtgatgctgaagtgagcagcccctccccacaccagttgaactgcaggaagagaggacccatcctgccacaggacccagaaaaaaagcccaacacacactcgggttaagaaatacctttaaatttaggtaaataaagctcaaggaggtggggctgtcatctgtggtgtcagtccttctggccccctggctgtcagtgtcgctccagggccttgacaagcagctcattcaagcggcccaccatggccctagggtcgtcaacaagtccagcagcaatcatggcgttctcgtatatctgaaaggcaagaggagaaacccattatgaggggcatggggcaccttttcatttttttttttttgagacagagtctcactgttgccgaggctggagtgcagaggcacgatctcggctcactgcaacctcaggtgatccccccgcctcccaaagtgctgggattacaggcgtgagccaccacgcctggccatttttccgtttttaaaacagaatttggctgggcacggtggctcacgaggtcaggagattgagaccatcctggccaagatggtgaaaaccccatctctactaaaatacaaaattagccaggcgcatgcctgtagtcccagctactcgggaggctgaggcaggggaattgcttgaacccgggaggcagaggttgtagtgagccaagatcgcgccactgcactccagcctggcaacagagcaacactccatctcaaaaaacaaacaaacaaacaaaaagacaggattttagaggaaaccgctgttccaccctgaaggcaggctggcagggctggtagcctgggtccctgcagtcatcctaagctgctgcactcacctgatccaccagcagctgagccaggccaggctcgcttgcgcgcagctgattcagcttcttgatgagcgcgtgcctgcaacacagaacccaccagaaaaagcagctcagtaccacgtgctgtgaccctcccttcatgttttgggattatcaggatatttaaagaagcacagtaagactgtctgtagttttttaaataaggtatgttaatgatcatttatagataatatcattatatacccagaaaacccaagagaatcaggagtgtcagtattagaaaatgctgtaaggtagccaaactccaagattaatatacactaaagggacaaaaggagcttagtacgtgaagacatgccttggttcctagataaataataaaagagaagggagtaagacccacatgttgaaacatattatagggctctagtaaataaaacagtttaggtctggaaagggggaaggcaaacaactccatgtaacgagggtggacactgagtgtctgatgaggacagtatttcacagaagagggaggagacagatcactccatccagcagcactgggatgactgggagccatgcagaaaaccatttagaccagagtaaattccagagggatcaaagatgacaagcacaattctagggaagaaatgtttcatcatctcagaaggggaaagcctttccaagcaaaaccacaaaccaaaaagtaaagaatgattgacatatttgacgtcagaacaatatttttttctgcataggaaaaagcatcatgtagtatttaaccttaacatgaatattataatttttcacttagaagtctgataaaaccgagggctctggggaactgtaaatttgtacaacctctccagaggacaactggagtcgggaaaaccacatgtggatgatatgctgagactcagccattccatttcctaactgcatccctttaaacacttttttttttagatagatagatagatagatagatagatagactctcactccttcacccaagctagagtgaaatggcatgatcttggctcaccgcagcctcctggtttcaagaggttctcttgcctcagcctcccaagtaactgggattacaggcacccaccaccacccccagctagtttttgtatttttagtagagatgaggtctcgaactcctgacctcaagtgatccacccgcctaggcctcccaaaatgttgggattacaggcgtgaggcaccgcacccaacctaacagaggaaacacttcaaatgcacatcctcacatttctagtctacgtagctggaaaaaaaggacattcttaatatgctaatgtggaggtcacctagttaccctaagggagaaaagcaaggcaaggacccactgcacagcaagttcccccttggaagcccacgggcgcagctgcccacaaatgcacataatctctgcagaaatacaaaagccctaatgctggctgcactggggacacaggtaggaggaaattttcccctgtaagcagttttgaattctgaactatgtggacagaacaccaaattttaaaacaaatgaaagtgaagctggctgggcacagtggctctcgcctgtaatcccaccactttgggaggccaaggctgcagtgagctctgatggcgccactggtacactccagcctaggtgacagagcaagaccctgtctccaaaagtgaagtggcaacagacagaaacgagcacttctgcagctatctcacaaaactagtttgccaccaaaactagttaaagtgacctggtgtccgcctcactgagctgctccagcagaggcacaggcattctgcatactggcgctgctgtgcactgacagccataagccaagtcagcctttccccaggagtgccatggctaggaagatgcatctccctcgcctccagtataattttaaaagttatggttgtaaaatgacaaaagaaaaaaactagacatgtactaaagaacaaaacaaaaactggctgggggtggtagcccacacttgtaatcccagcacttcgggaggctaaggcaggtggattgtttgaggccaggaggtagaagttgcagtgagctgagattgccccactgcactccaacctgggggacagagtgagaccctgtctcaaaaattaaaatactacttaggctacattgtggggggggtggtaagtctatggattttgatttcctttttgctgttttctatttttggtaacatgtttatgtaacttcattttttaaaaaattgctacattcaaaatttcccccaaaaaagaaacttcatatacaagttagttcatatacaagttagaaaatgaaattttaaaataccccataagacacatcaaagaataattctttaaaaatggtaccagaaccctacagagaatgtaaggtaccaaaggatgttaaagacctaaatagatcacattcatgggtgcaaagaagtgatactgtaaaaagaaagaaactcaaaagatacctaaaggcaggtgaaaagacatttacaacagataaagggcatataaagaacaacaggaagaaacgagggaaatcttacggctcagccactgtcagggctggggggttctcggtgcaccctggaagcagctcccaccaccggggccacagagaaacccacacaagccccagacacgtggacaagaatactcagagcagcctggctctccacaacttctgaccaagaaccaccggaggcccagcagagcagaacggagcagtctgctgtgccgaggtgggtttctgcagcggacattattcggctatgaaaatgaacttgtggcagcccctctgcatgggcaaccctcatgccaagtgagcaacgtgagacttcagcaaacaccaagatccacgtacaaagctcaaaacaggcaaaactgagcatgtccaggacacgcacaggtggcaaagccataaagcaaaacgaggacatggtcacaggctgggatgtggctaacctcccaggtgacacctggggatggtaaggggctggccaggttccatttcacatgggtgcagcctaaactgcatacagctccttatagttacccacatgtccacaggcctcacgcacttttcttctgtgtcacattccacaacaaaagaacaccacacacaggattctggggaatcccacaggctggaagagccaggagcgtggcctcacctggggttgatctccagcgtgggctgcaggagctgtgcgcgctcctcctgggtcttggccagctgctgcatgcgcaggaagtggcgggcagcccccatctccagcacggtgaccatggcagggtgggtgtccagtcggagggtcacctgtgagcaaagcccggggttgagggtgatagaggttcccaatgtgagagggctggcaggatcttaccaggggtgaaggtcacccagaccacgaggtagcaggcggggtctcaaggactcccctggaccagcgctgctccctccccattacccactaacttgtgggccctgagctgatgccccacgcaaagatactgtgcccgaggggctccaccaccctggtgccccgctgctgcctccaggagctgcccgaatccatcgtcctctgctccatgccagcccaccctgcatgaggccccttcctccaagtgaccatgcatgggacgctcatttctcactctgagctagacaggttggtggggggagtcttagctctctgaagcccacccaaaacccccgactaagcacccaagtgagcatgtgagctcctgagggctggggtagcatgtcccttgtttggaacccccacgtcctcagccattgcagctcccactcaggatgctggtttttcagttctcagttcacacctgctctggagcagggctgggagaaagacacggccttcctgcctcagcggcactcccgagcaacacgtgccgagcagggacccacagggtctccacctgacaccaagggcttctgctgctgctggaaggacacccaacgggccaggtactgggagccaccagctggccagcctgttagggacactgcggccaagtggtggtccatccccgggaaagcctcaccttcacgttggtgacacgcgaccccagcacatttctcatccaggccatgagctcctccgtctccttctctgataggcactcggcggctgcggaagagcaggcgacagggagctcaggcctgcatcccaactccccggcttccatgggggccacgcagcatgcttccagctcccacctcctctcccaccaggatggagacacaagctagcaagatgcttttcatctaaaagtaaaacctcaaaggatgcttcaggttgcctgaggcccatacaacttggttagggctttaaaaaaatacacagcctctcaagaagctgggccagctccagaagccaccgtggcaggagcactggacagacccctgatatctaaaccaggaggcaccttcctccagtcaccagggtgctcccacaaggctcttctcgggggtggctgagcccaggtcaactgacgaaaacccaaaggaagccctcgctgcggggcaggagaggcgtgcggggagtggaaaccagccccacgcctagagagcaggggatgccgacctggggacctgtcctcaaacttctcctccttgtagtgatccacgactatgtccgtctccacagagatcagcttcttcttgtcaaactcacgaaggtgcagcagggtgagctcatcaaactgctcaaagcagaagagaacctgcaggtggccaagagcagctccatcagaccccgggggcctccagccaccacagaagaaaggatgagggcggcaggagggctgggggagccaagcgggccacactggggaacaccggggcagttggggttcctaggcctgcatgacagttactacgacacctgggtctaaggaaggctctgactgccttcaaggcagaagcactccacgcataaagaaatccacatgtggctgagtgcagtggctcacgcctgtaatcccagcactttgggaggccaaagcaggcagatcatgaggtcaggagttcgagaccaacatggtgaaatgccgtctctattaaaaatacaaaaatttgctgggtgtggtggtgtgcacctgtagtcccagctactcaggaggctgaggcaggagaatgacctgaacccaggaggcggaagttgcagtgagccgagatcgcaccactgcactctagcctgggcgagagagcaagactccatctcaaaaaaacaaaaaacaaacaaaaaaaaccacatgtgacctccaagtgggaaacagccgtcacagtcggtccggcctctgtgcccgtgaccctgacccactgtgcagccctgcccggagtcttgggcaggttcacccagcacagagctgagaaggtcaagaccctccccaggttgcagcccccggagcccgccccacccaccgctcacccacctctgtgtctttcttcttcatggcctcatagtagggtgagtgctctgccaggtgacggttgggggcgcacaggtagtagatgttgcgggtgccggcccgcatgcggctggcgtattctgagaggctggttagctgcccggagggcagcgccgaggactcgtagcgcagcagctttgctatgtcctcctagaagggacggggcaggtcaccacttattccaggcccatgggctcaatgttgcccaactaactgggcgcaaaccctccgatgcccatggcctcctggcactccaggctggccctgacccgagggacggtagtggactcgggggttgtccgagagcaggccttgctctgcccatcaggccccttttgggagctctgggggcttaggaagcacctcctgccccaggtggcccaggggctctccagggagctacgcgcaccacgccctgggaggggaccccacccaacagcagagcccggcctggacccagcgtcttccctctgccctcagtgacagagtcagtctctggtgggcacacggacacgggtgaagtccacggttcccggccctcctcacagctggctatggcagagactggctttgcccagtgggtttcagtgggatttggagaagggcccttaggggaggggtttgccctcctccccatcagctgaacgcagctgtgacctctagagctcatgggagctgcagctggaaggacgcagggggaaaacagaaagagggaaaagcaaggagctggacacccaaccagcagggcccaggccacccctgcacacatggtgggtctgcattgataagacatgtcacacgtgcacacctacaaagacctagaaatgtctctgactcttacctgtgtgctgttaactcaaatgaagataaaggagaatgaagaggcctgtgtcagaagctgccgaagtcggcaaacaaccagaacacggcctccttgggaccccacacacgtggtcaccctcctcctgctgctggggagaagggacaccagcacgggatgggctcctgggatgaaatgttctggggttacagtggaggcagccacaccacactgtgaatgcactaaatgccactgaattttacgtgttaaaaggtgaattctgtgaatctgatgctatgtaagttgtatctcaataaaaaatggacaaaaaatgtttatggaacaaatgtttcgtttttcagccatccactattggattaactgaacgactggcccctgtagcatagtatttggagactgatatccagtacatgatgaatagtccctcaacagacactgagaccacccacttccccacccacgggatcggagtccttggcttgtcccacctgtctgtggctccccagcccccaacatcctctgaggggagacagtgtgtgcacgccctcttcctgccactccctgggctgcaccttcacacagcagtgaggctgagcccttcagagcacagcacagcactggtgggagggtaaggatgtgcctggaaggtgccagaggcccagaagcctggccttccatttcctgaccctggtggcagcagcagcagcagccagggtacccagctgcaccgtcgccacatcaggggacacctccaccagcttcctcagcagccccagggacaaggtggcccagaaaaaggcctggaacacagctcctataccttgacctcctgctcggtggcggtcacaatgccctcccgcatgaacaggccgtaatcttcaaaaaactttgcatacttctcagcatcttttttactctggtcaatgaagaatttgatcagcctctgctgtaaaacgtcccggagtttcctacagaaaagaaatgcatttaatacatacaagcagcctctatgaaatacaaatggccagagggtacgaaaaaatgttcagccccgctaagaatcaaagaagtgaaaacaacaaggtaccgttattggccaaactgaaaaagactgagcagaaagacagaaaccctgggcagtggccggacaggaggcagcagggtggagggcagacaccccctggaggcagtaggagaaccgatgcccccagagacaagatacccacgcccggaaaacccttccaacctttgagccagttgttccaattataggaactgcaccttaggaaacatgtgagcacaccaagatttatgtaccaggattttcactgtggcacataaaatataacaattatgaacaacctcatgttcaagaatataggctaaaattatgtaatgctaaatggccataaaaaaaaaaaactgcatcttttaataatcctcaatgacatgagaaagttagctgtgttgaaagaaaacccagaaaaatcccaatgtgggtaaattacagtacgtctatagatacaggcaaagaatgcacattctacatgtacataacaattttccatcattaggagcagcactgtatatactatatatgtacactgtaatttgggatttatactgaatatatgtatactctaatttttcaaaattgggattttagggatcaggatatttactgcagcattacataatggcctaaaattaggaacaactttatcactgggactagggatatttttattttcttcttaatatttagtctttcctttaagcaggtaaattacaatgtatttcaataatccagagcatgggaacaacactctctcgagttcatttagagcctttcctcccacactccatccccagtgactcagtccttcagccacagggcagaatgggacaggacatgccttcgtgcctgggagcggggggacagtagcccaggatgcggtgcagagcccagggaaggtgtctatgcagggccatggttgggaagagcctggtatgggtgtcagagcccaagaaccccagagaagggtgtccaggctgggggcgtgaccagcccaccgtgaagagtcagagcccaagtaggtgacagggacacccgcagaagagggcagtggcaatggtagattggttacatggagggggattggtcaaatgggtaaccgtgctaagaataatcaacggggcatggtggctcctgcctgtaatcgcaccactttgggaggctgaggcgggcggatcaccagaggtcaggagtttgagaccagcctggtcaacatggtaagcccccgtctctactaaaaatacaaaaaattaccagggcatggtggtgggtgactgtagtcccagctacttgaaaggctgaggcaggagaatcgcttgaatccgggaggcagaggtttcggtgagccaatacctcgccactgcactccagcctgagcaacagagtaagactccatctcaaaaataaataaataaataaataaataaaaataaaaaaattttattaatgatagcaagattataaactcttgaataaaacaggaaatcagcccatataaataaattataaatagtataaatataacacatcaatttttttttttttttccatccgacgaatcttgctcttgtcccccaggctggagtgcagtggcgtgatctcggctcactgcaacctctgcctcccgggttcaagcaattctcctgcctcagcctcccaagtagctgggattacaggcacctgccaccatacccggctgattttttttttttttttttttttgagatgagtctcgctctgtcgcccaggctggagtgcagtggcgtgattttggcgcactgcaatctccacctcccaggttcaagcaattctctgcctcagcctcccgagtggctgggattacacctgcctgccaccacgactggctaaaattttgtgtttttagtagagatggggtttcaccatcttggcaggctggtaactcctgacctcgtgatccacccgcctcggcctcccaaagtgctgggattacaggagtgagccattgcgcccagcctaatttttctattttttaagtagagacggggttttaccatgttggctaggctggtctcgaactcctgacctcaggtgatctgcctgcctcggcctcccaaagtgctgggattacaggcgtgagccaccgcgcccggccaacacataaatattttaagtaaataaatgaatgtattgagagtttcatgaagaatgtgacatttacatagcttcaaaatacctataacatctgttaattacaaagggaaggacatccttgtttgttggaaatgcaccccaaaggcatcgagaaggcaacttcctctcacaggattcgaggaaaaacatgttcttggtaccatgcttccaacttttaagcctgtgattctttcaaaagctctaatttcggctgactcttttctgatcgagatgagttctcagactgacaacgcaacctttgacaaccacaagctgggatgaggacccctgctctgcagcttcgggcactaccagtgggccagcatgcctgccacagccaggaatgcagctcccttactgagcaggaccacccctctgtgactcagtttccacaactatgagtgaggactcacggctcccctcacaggatgaaacacgtgtttatgcaggctcagcacagttctcagtggagaagaaatactcaggaaacacattcaggatggggagaggaacgcagccgcctcggcccgcagggacgccaggagctccctctccacagggcctggcccctgcctccacttcatccgtgagcttcccagatgaggccagacgtgtcctcagttcagtgggtgtcctttgccttatccagcccagggacattgtacctggaacctcccctcctgtggccactcctgggcagggtgatggggatggacaaggtggggacaactccagcaccagcaataataatccgggagtcagccccaagccctctcttcactgaagtgaactgaaacattgggcagatcaccagtaacccacaggcgcactcgaagtgcacagggtcagtacaccaaagagcacgactctaacgaccacagaacagtcgctgctgtggggcggggatgcatcctgttgaggtcagcacaactgctgccctgtggtcatgtcggcagcaagtcggggtcctgctgtcagaagccagcacggctgtgtgggg

SEQ ID NO: 1164 - DNA, 1126 bp, Homo sapiens
aatgtgtctgtcttttgcttgtgactttacattttgtgccctgtcatgattacattttgtgccctgttgtgaaaagtcttcctatccctgaagttattcttctacagttttctactactttgaataatcttttcttaatatttagatctttatcataaggatttatttttctaaatgaaaagaaattcccaaactatctttcagagttgtgctaccatttcacatccccaccagcaatatattagtgatctagtttctccacatccctgccagcatttgctgttgtcactgttttttattttagccactttgataggtgtgtaattaatcttactgtgggtttaatttgcatttccttagtgactaatgatgttgaatatcttttcatgtgtttatttgccatctgtgtatcctctttggtgaaatgtttcttcatgtcttttgtccattttctaattggattgtttacatttttactgttgagtcttgagaatgcttgatttattctcaatacaggttctttctatatatgtgatttgcaaatatattctctcgctctgtagcttatcttttaatcctcttaatagggtctttcacagatcaaaatttttaattcttatgaagtccaatgtattcatgtttagttttatagattgtgtgaagtctaggaattctttgcctagccctaaataataaatattttcttttctttttcttttttttgagacagagtctcactctgtagcccaggctggagtagagtggtgcaatctcggctcactgcaacctccgcctcccaggttcaagcaattctcctgcctcagcctcctgagtagctgggactacagacacacaccacaatgcccagctaatttttgtatttttagtagagatggggtttcactgtgttggccaggctggtctcgaactcctgacctcaaatgatctggctgcctcagcctcccaaagtgctgggattacaggtgttgagctaccatacccggcctctcctatgttttttcttaagtccactttgtgttaattttgtataaatgtgagacttaagtcatttattttgcctatggatgtccaattgccctttcaaacacacattgctcatataagc

SEQ ID NO: 1165 - DNA, 2278 bp, Homo sapiens
gagcagagatttccaatcaaggtgctttaactaaagaatttgcctttgggtatagagatggcgtgtggggatgggggtggaggggctctgttgatccttattgctttccaccatacagttattttattaagtcccctgatgattccccaggctcactctgttctttttatttttacattgtttagacttggaatttctctgtatcaacttttatcttgggagcagttttctactatgcatatattggttggctttatcctcagctctctaatcccatctgctctctgtcttctaggaatttctcaccatttatgatctgtcactggcaccctttcttgtttttcagccctgttatagatgttatggatatgcctctctctctatagatatatctatatagatatatgtagagaggaatgtggtacacagagaagatgtgtgtatttggtccgccatcttgattcaatttctgtaatatttattatatgtgttttatcgatttacttcctggaagtgagattaattaattttttatcgtgctgctataatgattaaattttgaagtagcatttagcgtgcagggagtacagtcacaatgtaatagcccctgggatttttgttctcttgagtataggttattagactctgtatggctttgttgtgattctgctaaacagagacttccagatgcggattgtcagacatgaacattatttctactattcaaacagatagggacgaagtggtccagcattgcttgttaaacttccttctagaagaataaatcaggataaatgcaatcaatgtaaatattaaacacattgaatgcagggcttatggaaggggtagtttaatattttaaaaattgaaataaaatgtacatataggaaagtgacagaccacaagtgtacagtatgatgtattttaacaaagtgacacattcatgtgatcagttcaagatatagaacattagtggcacccaagaggaccccttataaccttaatttacaagtaactaccacaccagcttcaatcaccatagattagcttttcctgtttttgaatattgtatgaatggaataatgcagtatgttctcttttttgaactttatgtaattagacataaatatattgagcttctttcattcaatgttatgtctgaaatttacccatgttgttacatattatgggagcagttaattctttttcattataatactatatagtgttgtattgtagaaatagccacaatgtaattattaattaatatgggcatttgtttctagttttttgttattatgagtaatactatttttacatggattttggtgcacatatgtaggaatttctgctgggtagataccagcagaattgctgagtcatagggtatggttatttttatgttcagctttagtagattctgccaaactgttttataaaatagttgcaccaatgtatactcctacaaatactgtatgagtgttccagttgcaccattaatccttggaaacacttgtgttgttgttgttgttttaaagtaattttgaccattctgatagtaatgtagtggcatctcattgtggttaatttgtatttccacgattataattaggtgaaaacattttcttatgcttattggccatttggattattgtcttagtccttacaggctgccacaacaaaaataccatagactaaatggtttaaataacaaatatttctcatgcttctggaggctggtaagtccataatcactgcactaccagatctggtgtctgataagggccttcctggttcacagatggcagtcttcttgctgtgtccctgtatggtggaagagtgggagagctttctctgaagtctcttttatatggtcactaattccattccagagggatctataatacctccatggcctatcatcttctgaagactctacctcctaatagtatcattgggcagttagaatttcaatttatgaattttgaggggacgcaaacattcaagccatagcagaaatcttctttttgtcaaattgcctatacaaggctcctttgactgttttttaaaatattgaatctatttgcctttttcttcatgactcatcagagttctttttaatatttgaatgtgattctttgtcagatagatgtgtggaaaacatcttctactctgtggcttgatatttctcagtcttctcttaggtttaatgaaatacaacatatgaatccttttcttgagagttagtattttggggtctggttgagatatcttctat

SEQ ID NO: 1166 - DNA, 9397 bp, Homo sapiens
tcctagggttatgttatcttgtagatatcataagattctaaaatctttaaatttttaccttaaacattattttaaggtcagtgaggaattatttttgaggtatggtgtaaagcaggggtcttaaattatttttaagaatagaaaggatacctgaaatcagagaatttgagaactggtgatttaaagctataaaattcccaaacaacagctttagctgcatctcgtaagcttaggttatatctatatatttgcattccttatttaaaaatattctctaatcttcatctttgactcaggctgtttatgcatgtgttgtttaatttccaaataattggaacattttcagatattgatttctatattaatttttatggtcagagaacctactctgcatgattttggtctttgaaattttagaaatgtgctttgtgattccgcatatggtctattttggtaaatgttccatgtctacttgaaaataatcattattttgtagttatttgctacagtgttctacatatgatggttcaagtcatgttaatctactgattgttttcgtctgcttgttttataagttgctgaaaggtgtattaaaatatttaaaaatatttggaattgtttctagttttagttttataagagtatgctttatacatcgtgaggctgtgttactaagtgcttaaagatttaggattgttatgtctcttttaaattgactttttacaattgtttaaatgttctttattctagtaataatgttttctgtataaaagtctattttgtaggatattagtatagattctaaaggtttttattgttgatgttagtgttttctttttttaaatttaaaatttctatgggtacatagaggcgtaagtatttatggcatatatcagatatttttatacaggcatacaataagtaaggattattacaatgtgtaatgattgtcagggtaaatggggtattcctcacctcaagcacttatttctttgtgttatgaacattctaattgtacttcctcagttactctaaaatgtacaacaaattattgctgactgtagccactctgttgtgatatcaaatattatctcttattcattatatctgactatatttttgtgcccattaaccatcccgattccctctactcccctgctacccttcccagcctccggtgaccatcgttctactctctgtcttcatgagttcaattgtttaaatttttagttcccacaaatgagaacatctgatgtttgtctttctgtgcctggcttatttcacttaacataatgtcctccacttccatctgtgttgttgcaaatgacaggatctcattcttttttatggctgaatatgtaccacattttctccatccattcatctgttgatggacacttagattgattccaaatcttggctattgtgaataatgctgcaataaatatgggcagcagatatctctttgatacactgatttcctgtcttctttcctagcagtgggatggctggatcatatggtaattctatttttttttttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggtaattctattttttgaggaaattccaaactgttctccatcgtggttgtacatccttaccaagggtgtatgagggttcccctttctccttgccagcattcgttattgcctatcttttggataaaagccattttaactggggtaagatgatatgtcattgtagttttgatttgcatttctctggtcatcagtgatgttgagcatcttttcatatacctgctagccatttgtatgccttcttttgagaaatgtctattcagatcttttgctcatttttaaattttattattagattctttttcctatagagttatttgacctccttttattctggttattaatcccttgtcagatggatagtttgtaaatattttctcccattctgtgggttgtcttttgactttgttgatgttgaaaagcctttgctatgcagaaactttttaacttgatatgatcccatctgtccatttttgctttggttgcctgtgcttttagggtattactcaagaaatctttgccaaaatcagtgtcctggagagttctcccaatgttttcttatagtagtttcacggtttgaggtcttagatttaagcctttaatccattttgatttgatttttgtatatggtgagagatagggatctagtttcactcttctgcatatggatacccagttttctcagcatcatttattgaaaagactgtcctttccccaatatattggttcttggcacctttgttgaaaaggatttcactgtagatgtatggatttatccctgggttctttgttttgttccattggtctgtgtgtctgttttttatgtcagtatcatgctgtttggttactacagctctgtagtataatttgaagtcagttaatgtgattactccagttttattcattttgctcaggatggctttggctattctgggtcttttgtgattccatataagttttaggattattttctctatttctgtgaagaatgtcattggtagtttgataaaagttgcattgagtttgtaggttgctttagtaggtatgaaattttaacaatattgattcttccaatccatgaacatgaactatctttctatttctggtgtcctcttcaattttttgcatcaatgctttatcgttttcattgtagagatatttaacttcttgggttaattcttaggtattttatgtaatttgtagcaattgtaaatgtgtttactttattgatttctttttcagattgttttttgtggacatatagacattctactgatttttgtatgttgattttgtatcctacaactttattgaatttgtttattggttctaatacctttctgatggagtatttagatttttccaaatataagatcatgttatttgcaaacaaggataatttgactttttcctttccaatttagatccctttttttctttatcatctgattagctacttttttttctttatcatctgattactccagtactatgttgaataacagtggtgaaagtgggcatccttgtcttgtcctttatcttacaggacaggcttgcattttttcctcattcagtatgataccagctgtgggtctgttgtatatggcttttattgtatggagatatgttccttcaatatccagtttttttagggtttttataatgaagggacattgaattttatcaaatgatttttcagcatcaattgaaatgatcatatggtttttgtccttcattctgttgatatgatgtatcacactaattgatttgcatatattgaaccattcttgcattcctgggttgaatcctacttggtcatgatgaataatctttttcttgtgttgccaaattcagtttggtagtagtttgttggggatttttgcattgatgttcatgagatatattggcccgtagttttgttgttgttttgtttgtttgtttgttttttgatgtatctttgactggtttaggtatcagggtaatactggcctcatagaatgggtttggaagtcttccctcctcctctattttttagtataatttgagtaggatttgtattagttcctctttaaatgtttggtagaattcagcagtgaagccatcatgtcccaggcttgttttgccagaagactttgtatttcaaacgagatcaaatgagaggtttgatcttgttacttgtcattagcctattcagactttggatttcttcatggtttaatattggtaggttgtacgtgtctaggaatttatctgtttcttctaggttttccaatttattgacatattgttgctcatagtagtctctaatgatcctttgaatttctgtggtattggttttaatgtctccttcttcatccctgattttatttatttgggtcttctctctttttcttagtctggctaaaggtttgtcaattttgttcgtcttttcaaaaaaaccaactttttgttttgttgaccttttatattgccttttctttttcaattttatttatttctgcctgattttaatttttttttctttactaattttgggtttggtttgctcttgcttttctagttctttagatgcatcattaggttatttatttgaagtttttctacttttttgatgtaggggcttattgctataaattttcctgttagtactgcttttgctgtatcccataggttttcgtatgttgtatttccattttcatttgtttcaaggaattttaaaatttccttcttcatttcttcattgacccactggtccttcagtagcatactgtttaattttcatgtgttcgtatagtttttagagtttctattattgatttctagttttattccattgtggtcagagaagacacttgatatggtttatccttgagaatgattgctgaggagaagaatgtgtattctgcagctgttggatgaaatgttctgtaaatatctatgaggtccatttggtctatagtgcagaataggtctgatgtttctttattgaaatgctaatgagtagtttacacaccacaattacagtgttattatagtctgtatttgtctatgtacttactgttaccagtgaattttgttccttcagataatttcttattgctcattaatgttcttttctttcagattgaaaaactcccattagcatggtgagtattagggagtgaaaagctcccattagcataggtctgatgttgatgaaatacttcagctttcgtttgtctgggaaagtctttatttctccttcatgtttgaaggatatttttgtaggatacaatattccaggataaaatctttttccttcagctctttaaatgtatcatgccactttcttccagtctgaaaggtttttactgagaaatctgctgccagacataatggagattctttatatgctatttttttcttttatcttgctgcttttaggatcctttctgtattctttacctttgggagtttgattattaaatgtcttgaagtagtcttatttaaattaaatctgcttggtgttctataccctttttgtacttgaatattgacatctttctccaggtttggaaagttttctattattatctctgtgaataacctttctatgctgatctcattctctacctcctctttaaggtcaataactcttagatttgcccttttgaagctattttctagatcttgttaggtttgctctattctttattattctttttccttttgtctcctctgtgtattttcaaataggcttgctaattcattcctctgcttgatcagttcttctgtttagagactgatgcattcttcagtttgtcagttgaatttttcagctccagaatttatgcttagttctttttaatgattttaatctctttgttaaatttatctgataggattctgaattccttcactgtattatcttggatttcattgaacttcttcaaaacagttcttttgaattctttgtctgaaaggtcacatatctccatcactctagaattggtcactggtaccttatttagttcatttggtgaggtcttgttttttctggacggtcttgatacttgtggatgttcattcatgtctgggcattgaagagttaggtatttattctaatcttcacaatctgggcttgtttatacctatcattcctctgaaggctttccaagtattcaaagggaattgagcatttgatctaagtctttggtcactgcagctatatgtgcattagggagtgccctaagcccagtaactctgagtcttgcagtcttgtataggtgctgcctcagtggtcttgggtaagatctgggagaattccttggattaccaggcagagtctcttgttcttttcccttactttcttccaaacaaatgcaatctctctctccatgctgagcttcttggagttagtggaggggtgatacaagcactcctgtgaccatcactgctgagattgtgctgtgtcacacctgaagccagaacagtactgggtcttgcccaagatgtattacaactatttcctgaattctgctgatgtttattcaagggccaaggactctttagtcagcagaagttgattcctgccagaaatggatctttcccttcagggcagtggatttccttctggcccagggtggatctagaaatgcagttcaggagctagggcctggaactgggggctgcaggagtctgcttgatgctttactgtactgtggctgagccgctacccaagttgcaagacaaagacctcttttttgctctcctttcctcaagcagaaggagtctctgcccagacaatcactgcctcaggcccatggcaactatagcttggctactgctgatgtttattcaaggcccaaggggtctttattcagcaggtggtgagttctgccaggtctgggtctctcctttcaatgcagtgggttcccttctggcccagggtgggttaaggaatgccctccaggagctaaggcctggaactgaggaaatgagaaatcctcttggtgctttagtttactgtggctctgctggtacccaagtcacaagatgaaatcctttttacacttccctttcctttcttcaagcaggagcctttccctgtggatactatagctgagaatgtgctgggtcacacatgaaaccagcacagtactgggtcttgccaaggcctgtgatgactgctgcctggctacagatggtgtttattcaaggcccaggggtgtttattcaaggcccaagggctcattagtcagcaggtagtgaattctgtgacactgggtcctttccttcagggtagagttcttttctggaccaggatgggtctagaaatgttgtctggaagctatggcctgaaatggggtctttaggactttgcttggtactttattttactgtgacggagctggtatccaaattgcaagacaaggtcctctttacacttccctcttcttacagaactgtgagccgcattgcctggagttggggaaggggtgatgcaagcactcccttggccactccagctggtgtatccctggaaagttctctattaataaagtttcctgggttgcatgcaccccagttccactggctgtaggcccagcagagcaccagtatttgtccaggaattgcagtccttgtggcctagactgcctttcaagtttatttaggaccccagaacactttatcccacagtggtggggctagccagaactcagtttctgactgctgggatggacgattgccctttggctagggctagtctaagtgctccctccacgggcactggccaaagccagtgggaaacactaggaaaggcctgtgttgctttccactgtgacagggcagcactgagttccaatgcaaattccccaaattactttgcccttcctcccgcaagtgcacagattctctctccatgccatgctgcactgctgggggatggaggaggagtagtgtcggcaattcaaaactatcattcctatcctcttcagtgcctctttcttggatacagagttaaaatcaggtgctgtgattgctcacctgatttttggttcttatgaaggtgatttcttgtgtggatagttgttctatttggtgttcctgcaggggggacgattgctggagggttctgttgagccatcttgctctgcctcctcctccagaaatcagtgttagtgtttttctgatgtatctttttgcacctgtttatttttctttcatgttattacctttagtgtgcatctcttattagcaggatatagtgtagcttttttttttttttttaaatgctggctgatgcttcttgtcttttaattggaatatttagtccattttcatttaatgtaattattgatatttttacatttaaatctgctatgttattatttgttttctatttatctcattcattctttgcttctttctcctttcttgccttcttttggattaatccctttaaagaattattccattttactactctagtagcttgctagttatatattattttataattatttaaaaagcaatactagaaattataacacacttttttttaatgtggtggtgtcttcattaaattagtactgtatcacttccaagcaatagaatagaccatacaacaagagtctcacttaactcccttagtggtggcttttgtgctatcatttttatgcttttgaaattctacatacatttaaaacctcacaagacattacttttattttaagctgtgaatattcatttagatttatctttctggagctcttcatttctttccctattttcttatttccatttgtttccatttatatatgtgtgtgtatatataataaaaaattatatgtgtctgtgtttccatttatatatatttatatatataaattcacatatattacataaatgtgtatatatataatacatacacactacatatataattttttaaagaactccctttagtgtttcttttggtgtttgtccgttgtgagaaattctctcaatgcttttgtctgaagatttctttgatgttgcctgtttatgagggatatattcattgacagggaatagaatctaagattggtagatattttctgccagcattttaaagatgtgatttcattgttttgtagctccttgatttctcttgtaacatcagctaagaatctttttgttgctcctttgaatgcaatgtgtatctttctctttgtctttggtcttcagcagtttgactataatgtgcctaggtatgtttatcttcatatttatcctgattggtattcatagagaagtttcaatctgtagcttggtgtcttttttctattttgaataattattgtccatctcctcttcaaatattgtttcttttcatttctttgaactctaaaatacacttgtgttaaggtattttcaccatgtctgatgtgcttatagtgctcttttttgtgtttttcatcttctttccctttatgtttcaatttagatactttctactgactgaacttccagttcacatattctctcagttgtcgtctaattgttattaaacacttctgttgggttcttaattttagttattggattttcatctgtaattttcatttgctttctttttatgtattccaatttttgataaaaattttacattgtcatttattttattcaacatatttat

SEQ ID NO: 1167 - DNA, 15471 bp, Homo sapiens
attttcaaagtgaaatcaaatggatccatgcctttcacatgtaactttctgttcaactgcttaaaattatttttattgatccataacatttgtacatgtttatggaatacatgtaatattttgctacatgcatactgtaatggtcaagccagggtatttagggtatctatcgcctttgtatttatcatttccatgtgttgggaacatttcaggtcattctcttctagctattttgaaacatacaatacattgttgttaattatagtcaccctactctgttatcgaacattaaaacttattctatctaactgtatgtttgcactcattagctaacctttcttcatcccctcaccccgcaacacacccttcccagcatctagtaactgtcattctgttctgcctccatgagatcagttgttttagctcccaaatatgagtgagaatatatgatgtttttctttgtgcctgacttattttacttgacataatgacctccatttccaaccatgttgctgcaaataacaggattttattcttttttatggttgaatagtattccattgtgtatatattccacactttctttatccatttatttgttgatgaacacatgattctgtgtctttgccattgttaatggtgttgcagtaaacatgggagtgcatgtatctctttgatatactgatttcttttcctttgaataaataccaaatagtgggattgttggattgtatggtagttctatttttagttttttgagaaatctccatactgttttccataatggctgtattaatttacattcccaccagcagtgtatgagagttctctttttttcatgttattagcgtctgttattttttgtctttttgttgatagccattcgaatttgataagatatctctattgtgtttttgatttgcatttccctgatgattagtgatggtgagcattttttcatatatcttttagccacttgtatatcttcttttgagaaatgtctattcaatatgctattttaaatgagattctttgtgcgtgtgtgtgtgtgtgtgtgtgtgtgtgttttgctgtggagttgagtttctttgtaaattctggatattagtttcttgttagatgaatagtttgtgaatatgttctcccattcaacaggttgcctcttcattctgttgattgtttcctttgatgtgcaaaaactttttactttaatatagttctatttgtttaattctgtttttcttacccatgcttctgagatcttagccataaaatgtttgcctagaacaatgccctggagtgtttcccctgagttttcttctggtagttcatagtttggggtcttatgtttaagtcttaaatctattttgagttgattttgggatatggtgagagatagggatccaatttcattcttctgcatatggataccgagttttccgagcatcatttattgaagagggtgtcctttccccaatgtatgttctgggcatctctgtaaaaaatcagttggctgtacatatgtggatttatttctgggttctctattcgtgttctgttggtctgtgtgactatttatatgctgataccgtgatgctttgattactatagttctgtaatttttttgacatcaggtagtgtgatgcttctagctttgttatttttgctcaggattgcattggctatttgggctcttttttggttccatatgaattttatgactgatgtttctatttctataaaaaatgtcattggtattttaatagggattgcactgaatatgtagattgctttaggtagtatgttcattttaacagtactaattcttcctggctattattaaaaagtcaaaaaaatcacagatgctggtgaggttgaggagaaaaaggaacacttatatactgttggtggaattagttcaatcattgtggaaagcagtgtggtgattcctcagagagctaaaaatagagctgccatttggcccagcaatcccattactggggtatatccagataaacataaattgttctatcataaagacacatgcacacatatgttcaatgcaacactatttgcaatagcaaaggcatggaatcaacctaaatgcccatcagtgctagattgaataaagaaaatgtggtacatacataccacggaatacaatgcagccttaaaaaagagtgagatcatgtcatttgcaggagcataaatggagctggaggccattatcgttaacaaagtaacacaggaacaaaaaaccaaaaactgcatgttcccactcatgagtgggagctaaatgatgagaacacatggactcttagaggggaacagcagacactgggccttccagagggtggagggttgaaggaaggagaggatcaggaaaaataactaatgggtactaggcttaatacttgggtgatgaaataatctgtacaaaaaacccctgtgacaggagtttgtcatataacaaacctgcacatgtacccctgaacttaaaaaaaaccaaaccatattaattcttctaactcatgatcataggatgtctttccatttgcttgtgtcctcttcaatttctttcatcaatgttttgtaattttccttgtagagatctttcacctccttggttaaatgtattcctaggtatttctttggtaactattgtaaatgggattgccttcttgatttctttttcagctatttattataggcgtaaagaaatgctactgatttttgcaggttgattttgtagcctgaaactgtactgaatttatcagatcttagagttttttggtgtagtctttaggtttttctaaatataagattttgtcatctgtaaagagaaacagtttgacttcctcttttccaatttggatgtagctattggatgaaatgttctgtaaatgtctgttaggttcatttggtctaaagtgtagtttaaatccaatgtttctttgttaattttttgcctagataatctgtctaatgttgatagtgggataaagtcttccactattattgtattggagtctaactctccctttagatataataatatttgctttatatatctgggtgcttcggttttggtgcacatacatttagatttattatttcattttctttattgatccccttatcattatataatgatgttctttgtttccttttactgtttttgacttaaagtctgttttatctgacataaatatagccattcctgctcacttttggtttctgtttgtgcagaatacctttttccatccctttacttttagtttatatgtgtctttacaggtgaaatgagtttcttatgggtggcatatagttggctaatgttttttaattcagccagtctatattttttaagtggaatatttactctgtttactttcaaggttattattgatatgcgaggacttattgtcataattttgttaattgtcatttggttttgtggttctttgttcctttctttctctcttagtgtttatcattgccacttgcaggtcttctgtagtggtaacatttgaatctctttttttttcctcatttgggtgtttgctctaccagtgagttttattcttttgtgtgttttcatgatggtagatatcatactctcacttccagatttagggctccgttaagcatttcttacagagctggactagtggtgatgaattatcttgtttttgcttgtctggaaaagactttatttctccttattttatgaaggataactttgctaggtatagtatttttggctgtcagcttttttctctttcagcactttgaacataaacctcaagcttattctctccttgcttgtaatctttctgcttagaaatctgctattagtctgatggggggcagttcccttatgtgactagatgcttttctcttgatgtttttagaaatctctgtctatctttggcttttgacagtatgctacagagaagacctttttaggttatatccatatctatttggggatctctgagattcctgtatctggatgtcttaatctcttgctagacttgggaagttttcagctgttattttgttgaatacgttttctatgcctttgtctttctcttcattttctggatcatccagaatttgaatatttggtcactttatggcatcccatatgtcatgtaggctttgttgattcttattcattcctttttcctttttcttttttgtctgattgggttatttcaaaacatttgtctttaagttctggaattcgtatgcttaatctagtctattgttgaacctcttgaataaattttttatttcatatattgaattcttcagttccaggatttctgttttgttctttttttcatatctgtctctttagtgaatttctcattcacattctgaattgtttttctggtatctttgtattgtttatctgtgtgctgttgtgtcttactgagcttccttaataacattattttgatttttttctgatatttaaaaaatttctatttcattggaatctgttgctagaaaactattgtgttcctttggaggtgtcatatttccttgctctttcatgtttcttgtgtttttatgttgatatctgcacatctgatgtaacagtcacttcttccatttttttggattggctttagagggggaagactttttcctgaagatgtgtttatgttgatggttaggtatagtgccttagctttgattctgggtgcaggcattggtgtagtctcggtatgatttatttgattgtgaacagcatggtgtctgtgattgtctcagtggcctggctgtggttgttagtggatgctgtggtgatgctttgctggggatgcctttgctggccccagcaggtgggccagtcctttgtgcccagtggtggcagtggtgggccaattatgccagccattaggctgctgggcagtgtacatgggcaccagtgttagcagatccaggcaggctgattcttgggcctccaggtggcttgctcagattccagcagtggcagcagtgggctggatgagtgggcaggtcctggggcccctgggcagtgtgtgtggcatgggagatagtagtaccagtggcaggacaacccttaggcttccaggcagttagtgatgttagtgatggttgtgatgggctgggtggcccctcctcaggtccccaggagtacaaagataccagtggtggtggactgggtagagtgatccgcaggcccctgggtgatgtactcaggcactcaagtcaggggtggttgtgccaggctaggtggtcctgtccttaaccttctgatggtatgcacgagtgcaggctgtggtgggacaatctgtggtggtgggtggggagagcttgtccccaaggtgcagataagtgcgcagcatccctgctgctcagtgggtggggcgggggtggggtggctgttagtgggagtgaccctaggcatttgggcagctttcaggctcttgggagtgtacacattagtccttagcagcagcagtaacagcaatgatgacagtgggcagggagcctgtcctcagagtgcatgctagtgcatagtggccacgcaggcaaacagctgtcaggctttggggaacatgcacattggctccccttgtttcagcagcacagcagcagcttccctggtgtgccacaccacccattccctgtggtgtgggactcttgagtgggctagagtgctagggaccctgctgcactgctgggtccagccagcatcatgctactgcagtcctccagtgtagggggttgttagtggtgcttcagggatgtcgagatgcaggggctatggcatcccagggcaggatgccctggttgaggttaggcactcagaatggtgctgttctgcagttgcttaggtatcaggggagtgtgtagagcactgttagttctctttctggagcaaggcctttgcacaatctctaggcagctccctgtgctagtctcagggcccaggaggatagagaggctcttccatggctaagatgacaggagtcaatggtgggaatgtggacttcttgggatctcttaccctttccctgcaccgggaacctctccaggcttctagctgatgccagctgaactggccgccttgctttcccttactttctgtgcctcaggtgtttcctgtcacttctctgctaaattccagtgttttcttttagatgttctatttgaaatgtgattatctatttcctattttggttcttttttggggaggtggtgagtgccagatacctctagtcagtcattttgaacctccccggcccctcctcaggtcaactgtttttttttttaataagaggatttttgccccttaattttctgggattatgtcccatataattcttgtaaggcaatctagacaaaattttcagtcattaattttgtgctttttttcttatgttgaaactactaaaacaacaggttggcttttcttcagttaatcatcatgattcatcttttccattatttgttaatttgccatctagcaattgtatgatgacaaattcttttttaccttttaaactttactgaaggcacctaggccaggagatcacatggttagagacattacatttatttccttccaacacaaagaaagacagcaaatagtaacaaccccccacccacacctatacccaagcaaaacaatattatcatgtttgctatcctacaagatccaatttcccttgacttttattggagaaaagtgtcagtactagaaattcaaacagaatccttaacatgcccacagattatttcagggatccttcagttcattttcttgagcagtagctggtcagagggcctactactttgtgtgcaccattctagtgctgaggataccataatgagtaatattcatgagtaagaccgtaatgaatataagaccctgtccccaggcatctcataggccactgtgggaagcacatcaataaatttcagcgcagaatggttaagtgctgtgtaagcttttaatgtattcaggagatctgcagaaggggcacccaactaggtctgaggagtcctaatgacctttgaaggctgtgtaggagttagctatatggaaaaacttccaggcaatgggaacagcatataaaacggcagaaaggaacagggtgattctgagtgaccaagagtttaggaatggagaagtgtgaggtgtttatgaggagggcaatgaatgaggctggagagaggtaagtggcaggcagatcgtggaaggatggtacactgtgttgagtatggattttattttaaaggtgatggaatcactgaatcactttggggaatagcattattcaacgggtgttttggataactcattggcagttgtatggaggaagaatttgaggagtcagttaggaggctgttagagcagttcagagatgagatgacagtagcctggactgaggatatgttcatgggaatggagaaaataaaatggaatcaagagatgtttgggatgtagagtggataacacttggggtggtgtgtgtgtgtctgagagagagagagacagaatgagagagagagagagagatgagagagatggaagacatatatgttagggaactctatgcagcatttgtggctctgaaggtttttatttggaaggtgttgattgaatctgtctttttttctgaaaacttcagcatgtacaagttgctgacttattggctgtttttaaaaacatctgaattctatatatacttctgagagtccattacatttttcttaggtctaggacagcttttagtttccagactatcaactgtgtgggtggtgattccactaattgagagaagggaagataggcaaataagtagaatgatgagtttgtaaattgtgtttgaggtatctttggaatatctaaagaaaatttccaaaaggcaattggatgtgaaaaaattgaagtttgagaagtttgggttggagttatggattttcaagtcagtagcaaaataggtgattaacgagttcatggtaatagacaaaatcatcccaggagattatttagggcaaacatgatagaaggccaaggttgtaacactaattgagaaaaagaaattataaaggtaattgagaagtgtctaaggaggaaggggatgatatttagactgcagaggccaagggaaggggtggtttcaaggtgggagtggacagtagatttagaatgtctcagatcatctaagctaggagcctgaatttatcctgggtatgaaggaattggatggtcattaatgacagcagttttaatggagccagattgtaaggtgtatcagttaggaatgagtttggctgcaagttaaagaaaacctaaccatagtggcttacagatctaggcttatttttctcatctagcatgaagtccagagatgggaggctgctggtgtttgttcaagaacttaatgatcatcagggtcttcttgcaattctcgaagcttattccttataatctcaagctgattgatgcagcctcatacatgttcatgttcaagataggaagaagggaggaagagtggcatcttcaaatcaggaaaccagtaatttccaagaaatccccacctgcagctaactacttaggtctcattgcccataatgagacatatgactacctgtagtcacaaggaatgctgggaaagcagggaatgttctggcatagtgatcattgcctgggctgggcccattgacactgtatgcaaaatttgggttctgttagtgaggaagaggagagtgtttattgagtggccagctaacagtgttggacttacataggttgagaaatgaatgggaagtgagaaaatggggacagtccatgtctatgacaccttaagaggcagttctgaggagtatggactagaaagggtggtagccagagtagaatatggggaaataatggaaggttacattctagaatatgaaaggcttgagtacatgtaaatgttgatgtgagtgggagagattgaagatgcaccggagctttcacaccccaggacaatacctagagacttgggatgggtgagggctgtgcttttctattgtaaaatggcagaaggggttcatataggagcttctgaagacaaatcggttaataggaaagagcatatacagaggcttaggatctggaaatacagtcatttaaaactatccatgttcagtatccatgtgtttccagtttaaagactactgctttaaatcatataacagtttctgttcagtcattagcatttccagttctatgtgataatcacaagttgaatgctgacttgatgttaattttctccccctccccagctagggttggcctcgggtagggcattgccacagggagggtgtgtgctccctttgagtctcttaccccagagtttcttgccctctgggtttggagtgtaggatgaaaggaggggaaagtggggcagggaagtttctgtttctttggtgattgcagtatggctttgatctctctggtccctggcaggtgttcagagctgacttattcgcaggtgtcccatttccttgctgagccaatttgtcttccctctggttagtatttacttgactcatgcaatgtacgtttttatttctggtggtactaactttttaaggatcctcttgggaagtatctccttaacttgggactcacttctggtcccagggtttaccaggctttgatctgccttgatgtttggggtgctgtgtttcaatatgttcccatagattgtgttggaagctcaattgctactgtaacagtattaaaaggtgggcctttaggaggtgattaggccatgaggtcttgctcccgtgaatggagagagtttggcctctattttctctctatctcatgtgctccctcctcccttctgttttctgccatgggatttacccttgccagatgctggtgccatgctgttggacttactggcctccaaaactgtgagctaaataaatatcttttctctataaattacccaattgctggtattctgttatagcagcagaaaatgggtcaaaacaggagtggagttacttctagtgcagcagtgtctctctgtcttcccctctctctccctctctccctctctccctccctcttgttggcttaggccgaaagattcgaaacctttgtgtctatgtatttttaaaagttcacagatccattgacctgattctgatattcacaggggctccctacagaccaagcaaatttaatgggaaaagaacacttgacttcataaagaagaaatttaaaatatattttataagaaaaatgaataaaatttaagaaaataaaaattaactccaggtcctaaaaacaaaacattcagaaaaatagttacctacttctgttcccctcagacttgttctcagcaacattaaatgccagaaagcagcagaaattgcaatatttccagagtattgaggaaggaatagaatgaccctcaaataccatacttagcttgatgcatagaaggcactaattttgttgttgttgttaaacaaataccagaatgcaaatgtcttttctctggggatggttgcagaaaagtatgtgtaactcattgtacttttgtaaaagaaaaacatgtgtttgtatatgtaaatttaggaaaaaggtggaaagaattgtctcagactgattaaacccaggaatggagggaactttacttcttaattcttataatgaagtcaaagttttaataaaatttggtaatattttacattttgtattttttagtttttgaaaaataccatctatgtaaaaaaaaggcaaacactatcatagatcaaagcctaattatacagtttttttatttaaaacaagctgttcttgcatattcattaaaaaaaaaactcaggtatattatttgtgccagaacagtctttagacctatatttattggtgaactttaagaataaaacattgtcagcttcaaccttctatgtccttttaaaggtgattaaactttcctaggttggacaggatggcttgaggagaatgacgtacattaatttttctagccaaattatttcatgtggctcagaacccattcagtcattctattatacaatctgatcttttaaactcatctaaatagctactcgacattgtccttatcaggcctaggtcaatgataaaggtacataacagaataaatctccctaaaggaagaaaggaaaagattaactctctcccaaatccccatgaaacttcatgttcctacatggacctgtttgtagtctggtccccagacactgttgagatctgggaacacggggtcccagaaagaaagcagccttcatgattaattcactttcaaaggttctgccttaaccattcagggtgttctaaaaagaatcttctgaaagaccacattttgctatgaaatcaatcaaaaacaaaataccagtcagaatcaaactttttaaaaggtcacactcatagaggcctccaattcatgatcattgggtacatgttgacaagctttttaggaaactttagagatatatggggaagatatcaatctcatctgtcaactgtaattgaaaatgggcaaaaaaatacaaatatataaaaactggcatcagtgctggaaactagagaagggcattgcccaacttggagaagttctgcctgatatgatgcaaactgtaggaagccacatgggccaaatcgtagacatcctttctgaaaaaaagataggatatgcaaaaagtgaatacaagtaaatcctaccagaccaggctgttactgcgcagctactaatttctatgtgtgagagctcagaggggtcagcccctgtacatattgggaacatttattctagttggaacccattttcccagagtgggtccacacttacaatcatttgcaggaagcccaaagccgagcctgaggacagcaagactttttctggatatggtggacagggcatccaggaagtgtggggtcctgggcacactcagccaagactgggtggggccaaacctttttctgtttcctgtctcatgttcttgtgctgggacatttccttgattctgcctttttctttttcttttcttttcttttcttttttttttttttttgagacagagtcttactctgttgcccaggctggagtgcagtggcacaatcttggctcactgcaacctctgccttcgggttcaagtgattctcctgtctcagcctcctgagtagctgaaattacagggatgtgccaccatgcccggctaatttttatatttttagtagagatagggtttcaccatgttggtcaggctggtcttgaacttctgactttgtgatccacccaaagtgctgggattacaggtgtaagccaccatgcccagccaactctgcctttttaataagcaattctgatttcagttttgtccattctgtgctcactcttttttattgagttttcctcctttcatttttcatggtagccttttcttgttttgtgcatatgaaatcgtctcaaattttcctattaggtattaatgaaaactttaaaaagttcccctctatactttgattatctctgtttcctttggatcattctaaagtttcctctttgacatttcctgtcgcactcctggttttcctaaaatttctgtggtttctgattgtcagtgtatcagaatgaaggactagacccatcactgtaggtagctggggtaggtttttgtctgtttacctcacagtcttccctccctactggaaggactgagtataggggtgggtgtggtgatcagttttatgctagggtcagtggccaagggggactcagggaggctggaaagaagggttttaccttggaatgcagggctttgctcttgggcagggctgcctcttcatgttgccccttctgtctgttggaatgttgggaaagatctctagcttctctcagatctccacatccactttggggccatcagcaaagtccactctctttagagtgtgggtacagtcttcagcctggggacaaatgccccagttgcctgttgcttagttgataatattaatggctaatatttaatgagacttaacagtgtcagatactgttctaaatactttccatacagtaatacttacaaggcagatactgttataatccacattttgtagataaggaattggaagcacagagaagttcacagttgcagtggagcagagatttccaatcaaggtgctttaactaaagaatttgcctttgggtatagagatggcgtgtggggatgggggtggaggggctctgttgatccttattgctttccaccatacagttattttattaagtcccctgatgattccccaggctcactctgttctttttatttttacattgtttagacttggaatttctctgtatcaacttttatcttgggagcagttttctactatgcatatattggttggctttatcctcagctctctaatcccatctgctctctgtcttctaggaatttctcaccatttatgatctgtcactggcaccctttcttgtttttcagccctgttatagatgttatggatatgcctctctctctatagatatatctatatagatatatgtagagaggaatgtggtacacagagaagatgtgtgtatttggtccgccatcttgattcaatttctgtaatatttattatatgtgttttatcgatttacttcctggaagtgagattaattaattttttatcgtgctgctataatgattaaattttgaagtagcatttagcgtgcagggagtacagtcacaatgtaatagcccctgggatttttgttctcttgagtataggttattagactctgtatggctttgttgtgattctgctaaacagagacttccagatgcggattgtcagacatgaacattatttctactattcaaacagatagggacgaagtggtccagcattgcttgttaaacttccttctagaagaataaatcaggataaatgcaatcaatgtaaatattaaacacattgaatgcagggcttatggaaggggtagtttaatattttaaaaattgaaataaaatgtacatataggaaagtgacagaccacaagtgtacagtatgatgtattttaacaaagtgacacattcatgtgatcagttcaagatatagaacattagtggcacccaagaggaccccttataaccttaatttacaagtaactaccacaccagcttcaatcaccatagattagcttttcctgtttttgaatattgtatgaatggaataatgcagtatgttctcttttttgaactttatgtaattagacataaatatattgagcttctttcattcaatgttatgtctgaaatttacccatgttgttacatattatgggagcagttaattctttttcattataatactatatagtgttgtattgtagaaatagccacaatgtaattattaattaatatgggcatttgtttctagttttttgttattatgagtaatactatttttacatggattttggtgcacatatgtaggaatttctgctgggtagataccagcagaattgctgagtcatagggtatggttatttttatgttcagctttagtagattctgccaaactgttttataaaatagttgcaccaatgtatactcctacaaatactgtatgagtgttccagttgcaccattaatccttggaaacacttgtgttgttgttgttgttttaaagtaattttgaccattctgatagtaatgtagtggcatctcattgtggttaatttgtatttccacgattataattaggtgaaaacattttcttatgcttattggccatttggattattgtcttagtccttacaggctgccacaacaaaaataccatagactaaatggtttaaataacaaatatttctcatgcttctggaggctggtaagtccataatcactgcactaccagatctggtgtctgataagggccttcctggttcacagatggcagtcttcttgctgtgtccctgtatggtggaagagtgggagagctttctctgaagtctcttttatatggtcactaattccattccagagggatctataatacctccatggcctatcatcttctgaagactctacctcctaatagtatcattgggcagttagaatttcaatttatgaattttgaggggacgcaaacattcaagccatagcagaaatcttctttttgtcaaattgcctatacaaggctcctttgactgttttttaaaatattgaatctatttgcctttttcttcatgactcatcagagttctttttaatatttgaatgtgattctttgtcagatagatgtgtggaaaacatcttctactctgtggcttgatatttctcagtcttctcttaggtttaatgaaatacaacatatgaatccttttcttgagagttagtattttggggtctggttgagatatcttctat

SEQ ID NO: 1168 - DNA, 4376 bp, Homo sapiens
acattgcagatttttcaagatgactctaaagatgttggcgttttgaaacattctgtcagaaaattgtattcaaaaagctttgagtgaacctgtgccatctgcccaacacagcggaatgccgaagaggcttaagacacagctgttaccgtcaagaagttttcagaaggcaccaaacagataaaactgctcttgctgagtggggtagataacagctggtcagtggccagcaggtgtgatcctgcagggtgagagctagtcccagaccactgaatctgggttaaggatagagtctaggccctaccctatacctcctgaccaaatcccaggaaccaatcatggtgcacgccagtaatttaaaaaccaaccagcagcttgggagtaagggtggaggtgcgactggggcgtccgccagagtgttcggggatgggaggaagctattcccaggatcctggaccagtagcccacctgttccctgcagggccacactgctagtccccaccctcaaagtctacccacagctcctctgctctgcagagcacaggctatgcaaaatgctgaagagcacggcgatctcagaaagctagggacagagaataggtcatgcttccaaggcttgcgggagagtagcgatggccccatgagatgtgttgcttactcgtaattctagtgaagccatgtgctgtgttctgctataggctgtgaacgtcagagttcaagactgctgactttcctcctgcttctcctgcctctagtatttgtgaaatttttagtaccgtgcataccgtgctgagtaatcaacaatgcctctggccgggtgcggtggctgacgcgtgtgattccaagactttgagagacgaggtgggaggatcgcttgagctcaggagttcaggaccagcctgggcaatgtagggaaaccttgtctttcctaaaatttttttaaaaattagccaggtatggtggcacgcacctgtggtcccagctattcaggaggctgaggtgggaggatcacctgagcccaggagatggaggcttcagggagctgtgattgcaccactacattccagccttggagtgcaaaaataaataaataaattattattataaaaataaataaatacaaatacaaatagaaaacaattcttcttaagaagaatgccctgacttaaatagctccatcacctgggttaaaggatataaacatttatgacagaatcatagaatcccagcttttttttttttttaatttcatagtgacctttaacagtaataggcagatctcagattaattcagttcatgccatgggccaagccctgtgctgactgcttcacacaactccatttgactgaatcctcccagcaaacttatggggcatcttccactagtatctgcattttatagaggagggcgctgaggctgagaaaggctgagtcgcttccaggcgtcacctgagcccacctgccttttaccactcagccgggccgccttgcagcagcgctggccgttgtcaggtgagtggattctgtacttgcaagttgagagagctgcgacccgtgtgacatattcgtaataactatatgatctatgttttcgtcacagactcagttttgggggaaatgcctatagtgaatgctaattgctccctttccacacttcctttcccctccatcaagtgagaacccaaattcatttagttttcctaagaatccccgaaagggctggttaaagtgcaggttcctggccccacatccagagaatctgaggctgtggcagtgccccaggagtgtgcgtttttattttcccctaaagtggttctgaagcaggagtctgggccctggagacttggcccatttggacagaactcagggtgttcatggagctgcccccagcctgtcttctgcagcatggcaccgtgcagagctgaggccctcctaggctgggctcagacctgggcgagcccctggagacaggagagggccctgggatcctgctgtacccggtcctgctgtgcctagaggggcagaagcatgaggtggcttgcagcgggccctgagagctcctgcccctctctgctcacaacaaaaaccaaaactagaggagaaaaggcctctgtttccaaatattacttttcgggttttttttcacatatgtctccactttggggcatttcctaatcccttttcagtctattattcctgccctgtgtgactgtaatggttgaagagccattgcctctgcttattaggggatttgttggaactgactcaatgtctatacgtgtgtgtgtatatatatatatatatatatttttttttttttttttttttttttgagacagtgtctcactttgttgtcccagctggagtgcagtggcacaatcttggctcattgcagcctccgcctcccaggttcgaggattctcctgcctcagcctcctgagtagctggaattacaggcgcgcgccaccacgcccggctaatttttgttttttttttttttttttgagacagagtctcgctctgtcgcccaggctggagttcagtggcgggatctcggctcactgcaagctccacctcccgggttcacgccattctcctgcctcagcctcccaagtagctgggactacaggcgcccgccactacgcccggctagtttttgtatttttagtagagacagggtttcaccatgttgatcaggctggtctcgaactcctgacctcgtgagccacctcacccggcctcaatgtctatattcttgtgcatgaaaacacaaccaagtaagcagggaaaaatcccaaaccccaaaatatcttgaatccttttcgtttgccatttgtttcttattcttttttctaattacaaaagaaatgtatgcttattctaaaaagtcaaagtaacagaacgtaaagaccaaccctaagtctacccaaccagaggtaatcactatctcttgttgtctttccttatcagttaggattgggctgagctgcaaatagcagagagtcctaccttatcaatccagctaaaaattcctggcgggtgggggctgtcagagcccaggctcttttcatctcttagcgtggccctgcctgccagaagggcagatttaggctttgtgggtcctccagcttacaagggcttgggaggcgtcctctaaaataatggaatgcaaaattaggtatcaaagcgagtgcttctgtggaatgagaattagaacataaatcatagtgaagttcactttttttttttttttttaaaacagtcttgctctgctgcccaggctggagtgcagtggcgcaatctcggcttactgtagcctccacctcccaggttcatgcaattctcgtgcctcagcctcagcctcccaagaagctgggactacaggcgtatgtgccactacgcctggctaattttggtatcattggtagagatggggtttcaccatgttggccagggtggtctcgaactcctggcctcaagtgatccacctgcctcagcctctcaaagtgttgggattacaggcatgagccacctcgcccggccccaattcacttttttttttttttttttttttgcgacagtgtctcgctctgtcacacaggctggaatgcggtagagcaaacatggctcactgtggcttcaacctcctaggcttaaacgatcttcccacctcagccccccaagtacaaattcaaatgttaaaaattggcagataacacaaacattataaaatctagaaaaataatgtttatattaactagctgcttggcaaacacctcatagtttttcttcatatatcttctgttttatgccctttgattgcttctgtatatggcaaattagtaatgttttacaagcataaacataaaaatgtaatgtttctgtctacatatatgaagatgtttttaatgttttctaccgagaaagaaaaaaagattagcctttcctgtaacatatttgatcaaattttcttaatattgattgattaaaaaactttgttttggcctcacatttagttcatggtaatgccctgtaaatctttttacttaaaaattatatgtataggctgggtgtggtggctcacgcctgtaatcccagcactttgggaggccaaggcgggcagatcacgaggtcaggagttcaagaccagcctggccaacatggtgaaactccgtctctactaaaaatacaaaaattagccaggcgtggtggtgtgcatctgtaatcccagctactcaggaggctgaggcaggagaattgcttgaacctgggaggcagaggttgcagtgagccgagatcgcgccattgcactctagctctgggcgacagagcaagactctgtcttgtgaaaaaaaaaaaaattatatgtatttttaaaa

SEQ ID NO: 1169 - DNA, 6051 bp, Homo sapiens
ccaagtccaatcacagtcttctagcacaatttttccagtaaagttttaaggtcttcaagtattaaaattcaagtatattttagcgacctaaccccacaggtggggaaggactattctggcaaagcctaaaggaaaattccagctggtgacattgacaacgccgggtgagctgccaacagcaacagcagagagatttgtcccctggcttgggcctggaccacaatgccagccctcagggaggggaaccagcaccagagagacaacaggggcaccagccaggtcactgggcaggagcaaggcagagcccccgggaaaggaatgatactggccattctagccccacgtgtgttagatatcggagtgcgggcacctcatggagtgtggaccaactcagggaacaggatgggagatagtcatcccagaaaggagctgaggtctacaaggcacttcacttctcaggacaggattattctgggtagtgggatgagtctgagccagcaggccttgaggttatggggtcaggagaaggggagctgggcaggaggaggcagagaaagagaagcgtggctgggctgtctgtggccttacaaaatagccaagagtcttaaaaaaggcatttctgtattcgaaaatgagcggtttataactgatgagtacagcagcacttcctgaaggtggaatggtgtatgctgttggtggatagggaagttagtcattaaacttcagccagaaagcagagtggcatcacatcttcatgcctgcacagtagctttctagactaaatggcattccacaacagtgctgcgacccgtggggcatgcaagcctcagtgagcagggggacactttggtgtcccactggcctcggtccagtgaagtcagtggagtccttccctttagaacgagcgttgggttgagaacatgggtttctacatcttccctcctgggaatggtttggtgtttgatcaaatgtgggtgcaccctgcctgccactttacaagctgggtgctctcctcaagtatggctttagttccttcttttctcctacttcccatttgacttcctttcttctttcaggctttctttaccttcatgtcatttgttcaagaaacaagtgataataagaaagatgtagtagggatagagggaggagtaagtcagctgctctgtccccagggactcacagttcagtgcagtgggtgagagacgagtcagtaagcattcattcattagtaagcagcaatcttccagaagtggcgtgaactgtcaggagttctagataaaacgctgagtgtgttcggggaggaagagatggctgctgagcaaggggatcagggaagacttcgtggaggagaaagtaccaacacctctgcagtgcctgcttcttacctggccctaagccgggcgcttcccttgtggtgtattgtgaggtcctaccgacaaccctgagaagtggctggtacaacccccattctacagaggaggaagccggggctctttctttctgtaactcctttgtgctaccaacttactgctcttttgtaaattcttaaaaagacctagcgatgaaccacagagccttcaggaaccctacctgccatgaccaccacccataccgcccgtggaaaaatcatggagtttagagatagactcggcttgaatctcagctgcctgccacttactggaagtgagaccaagaagtctctctttcctctctgtgcctctctgtaaaatgggggataatagtcaacaacatatttgtaaggattaagtgaaataacgggtatggcagaatctagcatgatgccttgaaataaatatttacttacttttccctaaattcccctaaaattatatgctggcttttaattttccccatgctactataatcatgttctggtaaaaatggagagatttactatttaaaattgcttaggatgatctcagacagtgactgaaatggttgtgattaggatggttaggagcatgatgactttgatgtaacctcattctcattaaggtgtttatgtctctgcagaggctgacagattctgtggaccaaggctcccactgtttatccattattcattgattctttttttctttatagaagagctaccagatggtgttcttgaatctgatgatgatgaagatgaagatgatgaagtaagttggaggttcttgacaccacatagaaaacccataccaaactattctctctttcctgccttgacaagttagtccagaaatggagatttttcattcctgctacactatttctcacaattctgagggttggctaaagctcagctgggtggtggttcgggtctcacttggggtctcatgtggggagcccagcggccatgtttgaagactcccacactcattgggttcacagcagagacgcagcattgcatgtcattcgagtttcatgggaagctgaacaatgaccattcttctgtgtgagcttttgctctgaaggggcacgagcctcggcctgtcttcctcaccggtgggagtgctgggcgtgtaggcgcctggcgagagtctctggcgtgaggggtcctgggtttagttcagagctaacggaactgaccagttttctctgttatttgcattcttttgacttgtgtttcctcagctgtgaaaaatctacttgcctggtgttttagagcatgaaggtttagaagttaatgtatgcgagtctctgaaatgatgtaaagaatggtgactcagggactgtagttggattttcagatgacaagattttacatggttttccttcagatacctaggaagaaaagacctgttgtcccctctggtcatccttgatttgcctgccttcatttgcagggagcagttactcctgcagtgaatgctggaacattttcatctattttggggggagcattcactgaaaaagtggatgtcagaggatgtttttttgtttggagtcgtggcctatcagcttgtaaaatgtgtaaaagccaggtttttgatcactgatggcatcagttgggaaagaggtatttaagagcccctgccagagaggatctgctaagatctgctgggagatgcttcctcagcaggcggcctctgtggctgccgttttcttcacaggctgcaggtggcatcagcgggtacgtgctcctgctggctcttcctgccttgtccagcagtgcagagcttgacctccagataggggtcctggcccctatcatcttctccaggcccctttgtttacaaaggtggaggcagagggaaaaacaccagcttgagctcacacagagagttgatggtggtaaaattgggtttagaacaggagtcggcagacactttgtgtaaaggaaaagataggaactattttagggcttgcaggccacacagtctctgttccaaccactcaattctgccattgtaacacggtggctgtcagcagtacataagtggctgaacgtggctgtgttcctgtaaaactatttatggacgctaaaaatttgaatttcatacaatttttgcatgtcattaaatattctttcaaatacttaaaaacacaaaaatcattcttagctggcgagcataggaaagcaggcacctgactcgtgggccattgtttgccagcccctaggcagttcccggacttgggcagccttctcttgattataatgagtcaccacctttgtgcctggcccttcaatatcattctaaatgatagtttaaattaatatttaattatttgtttttaacaactttttttcattgtgtcctaaagtttgtctcgagatctgttttcttcccttcttgtatcatccctttgggtttttcggtttgctttggtttttcattttgctttgtttttgctataaatcctgtttttatcttataagggaaaattcattttgttcaactgttctagttaatgatgagaactcaatttctggaaatttcattctgaaagcaattgtctactgtaaatgaacaaatacagaagtcttataattttctggacttttgctactcttttaagaggttgatgtttgaaaatacttgtgataactagaattttcagaagatttctagaagaggtttagttggaaaattataaggaaaagatctgtcatttgggccaaatgggactctgtgatgaaccccgggcagcagatgggggctccttctcccaggtaagcctcactgcgcatcaccggtgccagccggggcagtccgggcacagccggtcttgcctggattttactcagctttcaccggaggctagcattacgtttataactgtctttcaaagttggagggaaaaaagagagtgacagatcttaggctaaagaaaatttctaagaatcctttgagaagtagcactgttgttggaatgtggttatcacttcccaaggtgacagctctgaaggagacagcaaaattatttgcaaggtgttggagtcataccttatcttgcttagcagtgtaaatgttctttcatttaatatttagacccaaaacacagaaaaatgaaaccactgttttcagttagctgcttagcaactctaaagataaaatggttctaatggggccaggcacggtggctcacacctgcaatctcaacactttgggaggccgaggtgggcggatcacttgagaccagcctggcccacatggtgaaaccccatctctactaaaaatacaaaaattagctggttcatggtggcgtgcgcctgtaatcccagctactagggaagctgaggcacgagaatcacctgaacctgggaggcggaggctgcagtgagctaagatcctgccagtgcactccagcctaggcaacaaagcaagaccccatctcaaaaaaagtggggggctgtagtgggatggggcctgagaccagggtaaattatgctcactctaaatcacattgagctgaaatctgtgcgctcacaacttccaccactgctatccctgcttcactggaaactctcaagagaacccctgatgcaaagtctcgtttttctctgtaatttataatgacttgatctaatgtgctaacctaacaaagttatgtctgaatatacatacgtttatatactaaaattttaaaaaaaataaaggtagagctagaaatgcatcttctgatttatagactgtctaggatataatgtcaaatagaaaaaggaaatcataaagtaatttgaccaataatttcggaaaaagcaaatgtataaagacacagggctatggattatgtatgtgcctatgtagcggaaaggtgtggacatgtacgccctctttgctgacattataaactgcaaggggggaataggaataaggaagtttgggtgaaaaatgcagagaggccctgaggctcctcaagagagagaagtgagactaggacacggggtttagtggcgtggaagtcagttgctgtgcatttttgtgggttgatggagcaaaagcgaaatgaatggattgagggccaggtgggaagtgagaaaatggcttaagaagtgtatgctgctcctcgcccagtctggctgtgcacagaagagcaatagtggctgaagggggcatttttgtttgttttaagatgagagaaacctgagcatgttaaaatgctgatggagtagctccagccgagagggagagctggaacattcaaggcaggaagagtctacaggatggcattgaaaatatgggtgttttcattgttttctaaaccacttatactttcttggcccacaaagccccagacccatttaaacctccagagaaacaaaaccatcattagatcagcttggacaatacaccccagggaatggacaatgacagctgttatttaaggattcaaatgcatctcatttagcacttcagagaaatgtgttacctgatgcatttattttatatgaaacagacgtaatatgttacaaaagggctgttggtaaatcactaagcttaggagcctggttccgttgttctcacccccagtgactcaggtttccttactatatatcacagccagtttccttgtatggcttccttaagtagaaatgcaaga

SEQ ID NO: 1170 - DNA, 1136 bp, Homo sapiens
gcatatgtgattttgcctaaatttatacacctcctcttctcatgtaatctggagttgaggaaacagaagtctctcccagtggaagatgcactcaagtttctttttctctctcttctacctccctccttcctttgttcttttattgataaattacttttattgataaattactctcttcttttattgataaattactaagtgccagatgctgtgatgggtgctggcatgcagagataaggaaccagtagttactcttttagagtagttcacatcttaaaggcaataaaataggtacatatttaatatcatgtggcatataatatatggcacgtaacagagatacacatgggcagaagggagaatgactaactctacttggagaaatgggaaaaactttgaaactggaggcaacaaatggtgaatcttaaagagtgaatagatattgtccaggttccgactccatcagaaagaaaaagggcacagagtgtattcaattgcatgtagccccatggtccattgaggtacaagagtagggattagattgatacataatccaagagtttttttccccctatgacttggattatttgttgaattgtttccttagacttccaaggataatgatgtattaagaccctacatggtataatgaaaggaacatagatctggcaagagaccaaatttgcacgtgaccttagtcaagtcacgtttcttttctaggctttaattttttcaactctaatataaggagttttgggcaggacacatccgactgaaggtttgcagaagtcctgagagacagtatgaaatgagattggtctgtctttaggagaggtaggctggaaggctaccttggtgaatttactatagttcagtatctggtttctaattttggaagtccagaaacttctcatcaatgctacagagatctggacttgagtatctgatctacacagactaaatttagaataaactatatacatatagaccaatttattgatttatagtaaatactcttgtcagcttgccctaaaatttattaaaaattatagggaaatctacattttaatcaaaagttactcaagtatggacttccagcaaaaagaattgaatgatttaaatattttatgatatta

SEQ ID NO: 1171 - DNA, 7734 bp, Homo sapiens
ttccttgaaagccttctctgcattctagagatgttgaatgtaggtcttcaaatagagaatcattaaagaaactttcatttcagaccaccatggaatgacagggatgagattaccctcatgccttaaacaattagataattagtatagatacataaaaagtggttttcagacattggacagcaggctatgcaggacaatgatccctgaaagaagagaaacaaacaagatgacccttataaatggcccagagcatcatctgaaaaaaatgtttccagatcaaagcacagagagggagaacccaaaccgaatccagtagcctcactgagtggaggggacagagttcagagttcggagagaccaaggcagctagaaatcatggtgcaagttactgaagaggaaggaactattccaagatggactgccagaaatgtgcagatgggtcttttgagtctttggctgagggtgaatgttagcatgctggagagaagaatacccaaagccaggggagaaaactgaaaagaggtaatcacaacaatttctgaaggtcacaaagggctgggaagagtttgtattcccaacaggtaaaggggcaatacacaggtaaataatacacacaacatcaggtagaacccatgaaagggcatggtcttggtagaggagctaaattagccttagaatgatttctggaactaccctaatgaagcaaagcttccaagcctacaagagattccaagtagcttaactgcatactagaagaaaatccaacactagaaaaggaatatgacaaaatccagcaacccaaaaagtaaaattcacaatatctaccatcaattcaaaatggcaagacatacaaagaagcaagaaaagataacctgtgcccaggagaaaaaccaatcaatggcaacaaaagcagaaacaacacaaatgatacaattagaagacagaaacattgagattgctattatcatgattttccatatgttcaggaagtagacaaaagcatgagcatgattagaagataaatggaagctttttactccccagctttattaaggtataattgacaaataaaaattgtatatatttaaggcacacaacatgatgatttgatacaggtgtacattgtgaaatgattaccaccaaattgataaacacatctattatctcacataattacattttgtgtgaatgtgtggtgataacacaagatctactcctttcgtgaattaaagtatacaatatgatattaagtatagtcaccatgctgtacattagatactcagtacttattcatcttgtaatgaaagtctgtactctttgacgaacatctcccattttcactgtgctctgctcttttcccttctccaggctctgacaatcaccattttaccctctgcttctatgagttctaattttttatttcacatataagtgagatcatatagtacttgtctttctatgtctggcttgtttcatcttatataatgtcctccaggttcattcatgtcgtggcaagtgacaggattttcttcttttttacaactaaataatattcctctgtgtgtgtctgtgagaaaatcacatgttctttatccattcatccatcaatggacacttagattgtttccatctcttggctataatggatagtgctccaatgaacatgacactgctggcatcttagagatactgatgtcatttcctttgggtatatacccagaagtgagacagcaggatcatacagtagttcaattttaaagttttttgaggaatatccatactgtttccatactggctgtaccaatttacatttccatcaacggtgtataagggttcacttttcttctcatcctcaccaacgtttgttatctcttgtctttttcataatagccatcctaacaggtatgaagtgatgccttgtggttttaatttgcatttctcttatgattaatgatgttaaatgccttttcatgtacctgctggtcaattgtatgccttttttaaaaaaaacatttatctagatcatttgcacaattttaaattaggggtttttttgtttgggttggttgctattgaattgtataagtttcttatatattttagatattaaccatttatcagatgtataatttgcaaatattttctcccattctatagtttgccttttcatcttgatttttttctttgttgttcagaagattttagttttatgtagtccaacttgtttatttttgtttgtgttgcctgtgcttttgatgtcatattaaaaaaatctttggcaagaccaatatcaaggagctttccccctatgtttacttctaggagtattagtttcaaatgtcacatttaaatctgaattcatttcaactttttttatgtgtatgatgtaaaacaacggtctaattccattattttgcatgtgaatacctatttttcccaacatcatttatttaagaaactatcctttccctgttgtgtattcttgacacccttatcaaagatgcgttgagtgatgtgcataggtttatttctggtctcttagtctgttctattggtctgtttgtctgtttttattctagtactatactcctttgattaccagagctttgtaatatagcttgaaatcaggaagtgtgatgcttccagttttgttattgtaatgcaattttgcattggatattcagagctgtttgtggttgtatgtgaaatctaggattgtctttctgcttctgtgaaaaaatccactggaattgtgttgaatctgtagataacttttcgtagcatgagcattttaacaacgttaatccttccaattcattaacacagaatatcattctatttatttgtgtcttcttccatcagcatctcacagtttgcactatagatcttttatctccttagttaaatttattcctaagtattttattctttttggtgctagtgtaaatttgattgttttcttaatctcttttttgcatattttgttgctaatgtacagaaacaaaattttttgcacattgattttatatactgcaactttactaaatttattagttctaacagtttcttggtggagttttagcatttctataaataagattatgtcatctgcagagagagaccatttagcttcttcctttccaatttgaatcttttatttctttttcctaattgctctggctagaacttccagtactatattgaataaaagttgtgacagtgggcattcctctcttatttctgatcttagagaaagagctttcagcttttcactgttgtgtataatgttagcagtgggcttgtcatacatggcctttattatgttgaggtacatttcttctatacctaatttgttgagaatttttattatgaaaggatgttgattttgtcaaatgctttttccccatctattgagataatcatatatttttcataatccattctgttatgtggtacatcatgtttactgacttctgtatgttaaaccatccttactttccagtgataaatcctacttgatcagggtgtatgattctattaatgtgctgttgaattcaatttgctagtattttgctgaggatttttgcatctatgttcagcagggatgttggcctgtaatgttctgttctcttagtgttcttatttggctttgatatgaaaatcatgctgccattgtaaaattagtttgggagaattctgtcctcttcaactttatcaaagtgtttgacaaggactggtattaattcgtctttaaatgtttggtagaattcacccatgatccatctgctcctgggtttgtctttgataagaggtttttgattactggtttcatctcttttctcactattggtctgttcagattttctgtttcttcatggttagtcttgagaggttgtatgtttctgggaatttattttttatttttatttaagacagggtctccctctgttgcccatgctggggtacagttgcatgatcattgctcactgcagcttcaacctcctgggctcaagcaatcctcccacctcagcttctcaaatagctgggactatgggtgcatgccaccacacctgactaatttttgcattttttgtagaaatggggttttgtcatgttgcccaggctggtctcggactcctgagctcaagccctccacccacctcggcctcccaaagtgctgcaattacaggtgtgagccacagcacccagcctgggaatttctttagagaaatggaagctttccaaaatatacaaagggaacttctagacataaaaaatttaaatatctgaaatgaaaaaatatacttcatgagattagtagcagattaaatactgcagaagaaaagatcttgaactagaagaaacagcaacagaaactattaaagtgcaaagagaaataaagaagaaaattgaacagaacctcaacaacttgtgaaacactatcaagcaatctaagatatgtataactagaatcccagaaggaattgagattggaaagtgggtgatggtaacaactgtgaagaaatcatggccaaatctttccaaattttatgaagacctataaatccaagaagctcaatgaaccataaaaaattgaacataaataaaaccacaataagatgcatcataacaaaataaatgaaaaccagaacaaagaaaaaatcttagaagtgggcaaactaaaaaatatattacatacagagatacaaaggtaagaatgctagtaaacttacttaaaactacgcaaaacaaaactaactgatgcaatatcaaatacagaaaaccaaccatcaacctacttagattttattatctagtaaaaacacattttataaataaaggttaaataaagcccatttcagaaaaaaatatataaaaacattcattgccgagagctctgcaatatttcaaagaactatttaaggaggtactaaaatcgtatagaaaatgatagctttatagatggaaatttggatctacacaagggaataaacataaaagttaaatatttggataaatatgaaagatttttctcatttttaatttcttcaaaagataaattatgatttaaagtgaaaataacaattgtaatacagtatataacatgagtaggaataaaatatatgacattaataccacagagccaagaggagggcaatggaactatactgttgtaaggtttccatatgctaataagagtgcttcaaaataaataaagaaaaattgctagaactgaaagaagaaatatgcaaatccacaaggataattggagatttcaacacacctcattaaataattgacataactatgaaaaaatcagttaatgtacggaagacttgaaaaacactttcaaccaatggaacctaaacgacatgtattttaaaactccaccaaataacagcactatatgcattcatttcaagtgcacgtggcatgttttgcaatttgatcatactgtgagacataaaacaagtcttaaaaagttaagacgtatgacaatcacaacagaaatgaactagatatgagtaataggaatatacctaggaaaattttaagatatttggcactcaactagtgtattttaaataactcatgggtcaaaaattacagagaaataagaaaatagtttgaactgaataaaaattaaatcacacatactaagatttgtgggatgttgctaatgtagtacctacagggaaatttccagcactaaattcttatattaaaaaataatgcatgcaaggtttttagctttcagcttaaaaaactagaaagagcagagaaaactgaacctaaaataaagaaaaagacataataaagaaatcaattaaatggaaaacaaagaaaaaagaaaatccatgacaccaaccaagaactgttcttttgagaaattgacaaaattggtaagcttctagtaaaaaaaaaaagaatttaataggaaaataatatataaaaggtataaattatcaacagtacaaagggaaggaaggaatttatcactaagattctacagacaccgaaagtatactaaaaggatataatgagtaatgttatgctaataaattttacaacttatatgaaaatgacaaattccttgaaaatactttctaccaaagcttactgtagaagaaataatctggatagtcatataacaattcaagatattgaagtagttataaatctttataaaaattgtgtaggcctagatggtttcattgatgcctttctaccaaacatttaatcttctagaaaatagaagatgatggaacactttacagctcctttcagaaaccagacacagaatcaccttgacactaaaaccagacaaaaacattatatagaaaaaaaacttttagaccaatatacctctttaacataagttcaaaaatctttaacaaagtattagcaaatggaatacaacaatatattaaagaataatatatcatagtcaagtgcagttcatcccagaaataaaaggttggtccaacattcaaaaacaaatcattaattcaccattttaacacactaaaaataaaagaccacacagccatttccatagatgcagcaattcctctcctaggtatttaatcaagagaaatgaaaacatatgttcatacacggactttgcagatgaatgttcataagttttatttcagataaacaaaatctagaagcaactcaaactgttcatcaatatgtgattgtgatgtatgtatagaataaatcactattcagcaatataaaggaatgaactgctaatacagtcaacaatataacatggatgaactttaaaagcaccatgctaagggaaagaaatgctacaaaagattatatgcatatggttctcttaatatgaacctctgggaaatgtaaaattgtattggtttccaagggtgaaggggtcagaggagttcctctactacaatgaggcacaagggaacattttgggatcataaaaatattacatatcctgcttttacagcactgtatacacttgtgaaaactcacaaaattgtaaatttgaaattaaagaattttactataagtaaataatatctcaacagaatagatatttaaaagactataaggttttcacaagtcttaaattttagactataaactctcaacatctccctttttcctaagtcttttaaaatgaaagttcaattttaagaaaagtttcacacaaaagtaattcatgcaaattatttttaaaaatagaaaatgtagaaatgtacaaaaagacaataactatcatccagagataaatacttattttttgcagctttccttccagagtttttcttctatagttatgagagaatataaaaaatttaataatactgtatatgtgattcaatatcttgcttttatcactaaaactacaaaattaaaacctaatatatggaatttatttccctgattagaaaactcagaatatctagttcataagtattgcaaaataactctttccaacttaaaaaattccagttagaaaatatgttttatggtgaaacaatattatattagtaaaataaaagcctgaaaaagtttcatttggtcttatttagatgaaaacaaatgaattttcaagacttgcttctcatctatacaccaatggctccatccaatctcccacacccacaaaaattaaaaaaaaaaaaaacatttgtttttggttttattttgctgaagcatctgaaaggcagtttgctgagagccaaactgggggaa

SEQ ID NO: 1172 - DNA, 2181 bp, Homo sapiens
aacctgttggttgctttttcctttaaagaaaaccgtccaaagataaactgcttcgggaaggcgctgcctccgctggcagcgctccgctcctcgccggatagggctggggagagacggttagggctcggattccagggaaaggactctttaaaaaagaagggggagaagaaagattgcaaccactccctgttggagaggcgtcaacagttcggtccccgcgagctgtctccaaatctcttaagttaacccctttcctttcctccccgctccgcctcctgtaaccaaactaccgactcccccaccctctctttccaagctgggcccttcaggcagtgcccggagaccagaaccctcagcttcccggaaaagggcacaggaaacgggagaagaacagggagaaagggaaggttctcacctccacggatcccgccgagaagagcagacagtccccagccagcctgggtcctccgtccctgggtcactccgctgagaagcgcgactcagagccgggctggcgcccggaaagtttagcgacaggctgggtacccgtggcagcggcacatggcagcaggtgggggcgactcagagtggggggcgcccccagaacaggggcggcgcaggccggtcactcgccctctcctcctcgggagccccccgcatgatccagacggagccgggcaggggcaggccgtgcgttctccccggggccgggagccggacggagggcgagcgcgcctggcagcacctgggcgggaggaaggcgggaggcgggggccgtgggaccccgccgcctcacagcaccgcgagcagccggcgctggccaggccgggactgcatggtgagcgccggccgccgcgtcccgcccgccgctcgcctcctcccctgcagggggctccgcgctccagtggactcctgggggcggtggcgacgctctcgggacgtgccctgctcggctcctcccccgcgctctcgcaccctttcgcccacctctggcgagcacggaaccgcgcgcggcggcgaccacagcggactcacggccgcaggctggctgccctctcccgccccgcccgggtcacctgcttctaatgcccgccgggaagccccgccccggctccgccccctcaggcccgggcgcggttggtgggccgcctcgccaagctctccgcgcgtccccgcccactgccccgcgggctcggcctttcccccggcgccctctggccccgccaggagcgggcagccaaggagcgctgaccaatcgcgggcctggaggagatgggggcggggcgaatgctaatcatgccgctctgggcacccgggcgggaagcccttgccagaagtccctccggagttctctgcccgcgccctgggtgcaggactcgctcctgtaacttcctggcttatgcacctttgctcccagggcccctgccctttctgcctgcagctaagcgtccttacagagttcagtgcttctttgaaagaactgctcaaggaatcactcttaggcgtggctgtctcccttccgagctgtcttggaactgtgtgaaagaagagaggatacttactgagccctttactgtgtgcccaacaaagtgttaatcggttacatcctttttttttttttttttttttgagacgagttgttctgtctcccaggctggagtgcagtggcgcgatctcggctcactgcaacctctgtctcccgggttcaagcgattatcctgcctcagcctcctgcgtagctgggattactggcgcccgccaccacgcccagctaatttttgtatttttggtagagacgggctttcaccatgtaaggctgttctcgaactcctgacaccgtgatctgcccgcctcggcctcccaaaatgctgggattacaggtgtgagccaccgcgcccggcccgtttacatcttaagacaagatctcactccttacaacaattctgaggcaggtacttcctacaggtgaagaaaccgagactgagacttggccaaggcaaccgagctaatcatagttcccccaagaaagggcgacctcggcaagcaagttcacctccgtattccgatcacctggcacatagtagccgcccaaatggcaaccctgggattcgaacccaggtagttggtcagcggcactcaccatcgtagccgcccctccccccatactatcgcagcctccct

SEQ ID NO: 1173 - DNA, 2269 bp, Homo sapiens
aatatattttcccaattgagaccacacagttcaaagaaacctgaaccaagtggaacttcattacaacgccaaccttaggattgtaaagcccccaaagcaaaggtaaattgttgccaaaatgcaacaaagttacaaattaagaaaaatacatataaattaaaaagagggttcccataaagaaggcagtaagaaacgcaaaatagaatacacgtgagctgggccccttggagaagacctgggacaggttcttcctcgaaaacgcccctcttccctctctccaagtcgccgcgggagggggcaacagcaccatgaaggtaaacggaagtgaccttggcaaaactaccaaacaaaacgcccccctcccctcagctctccggccgagtccctcggcggcagcctcctacacgtgcgacagggacacctgcttgtggtaggtggcggcggggcccggcggcccggtcctgcctgtgagcgcggcgctcgcctcggggtagtcccctgcggccatggcgcccccgctcttgtggccgcgccgcgggcggcagcagcagcggctggtgaaacgccgccacgactccaccgtcttgcccgaccagatccagacgcccgacgtgatgcccaccaccaggcacatgaagtacttgagcatgagcacccagtactcgggcttggcgcgcggctggccggtgtcgtggcccgggcaggcgcaggtgagcgccgcctcccagctctcgcggtagtgctgctcgtacaggtagcaggccaccacaatgctggcggggaccgtgtagagcagcgtgaagatgccgatgcggatcatgagcttctccagcttgtccgtcttggtgccgccctgcttgatgacgctgcggatgcggaagagcgacacgaagcccgccagcaggaagagcgtgcccaccagcaggtagagcaccagcgggcccagcacgaagccgcgcagcgagttcaggttctggttgcccacgtagcagatgccggccactgggtccccgtccacggagctcagcgccagtgccgtgatggacttgacgctggggatgagccacgcagccaggtggaagtactgcgcgtagcccgcgatggcctcgttgccccacttcatgccggcggccaggaaccaggtgagcgacaggatgacccaccagatggagctggccatgccgaagaagtagaccaggaggaagacgatggtgcacagtgcagggcccgtggtctcgtagtggatgtggttgtgctcgcggctgcaggccacgctggcatggcccacgaccagacgcaccaggaagcccagcgacacgcacaggtagcaggctgacaggaagatgatggggcgctcaggatagcggaagcgttccatgtcgatgaggaaggtggccactgtggtggacgtggagatgaagcacagcaccgaccacaggcctatccagaaggtggcgaacgtgcgctcgtcggcactgaaggacggctggtagcagggtaccgcgcagttgggcacctggcccgtccgcaccttgttgtagagcgggtgtgactccttcagaatgggcacgaagggctcgcgacacttgcacacgaacgggcccccagcggggcattcgccccccgaggccggcgcccctggcgggcctggaagggtgggcttggctgggaaaggcctggggggcgccgtggtggcctcgctgcggttgtaatccatgcagaggacctcggcgtcgcggcccagcaccgggaggcggtcgcagctcatgcgctcgggccaggcgaagccgtactggcgcatcagcggcgagcagccggccttggcgcgctcgcacaccgagcggcagggcggcagcggcttgtggtagtcgggcagacagatgggcgtgtacatagagcataggaagaagcgcaggtccggcgagcattggatctccaccagcggccagaactggtgcacctccaggcccgcctcgtcctgcgtgtcgtggttgaactggttgggcatgtgcgtcaggttgtagccgatgccgcggcacatgggcaccgtgatttcctggcacaccggggccttggacgcggcggccgcccggcccaccagctgcgctaggagcagcagcaacagcgagggcggcgcggatgggtcaggccgagccatcgccccctccctcccctcgcctccagcagcccgcgagggacgcacacaggcagaggaatccgggccggggcttctccctccggcgtctcgtgtgtggcgccggggctggca

SEQ ID NO: 1174 - DNA, 1159 bp, Homo sapiens
atgctggttatttaatttaacaacttaccgagaaaagatgtatactaagaaaagtaggggtacctacctaccagtcagtggggagaaaattaagaaagaaatgccccttttgctatagagggaaggaagaaagtgaaacccaaaaaagtcaggcattttcacagatgacttccttgtggatagctaaagtatgtactggctttgcaactctaaaaaacagctttttttttttttttttttgtgaaacaagatggtttgtcggcatttatagctctttgcccatttcaagtaatttttatgtaatttttaaatgtgatctggtgccttcaaagtttcagagaaatagagaaaggctttaggactgcagatagcgcctgataaagttgaactatcgctactacttattaagtgtctcttatgagccagtactgtgctgggtgcttgctactcactactttcaaataatggtcctgaaagtgaacattaatatccccttttgcaaatgaggaaaccgaggttcagagaggttaagtaacatgcccaaggtcacacagctaagtggtatcgctgggacttgaacccatgtcttccgaggccatggcagctgcgaactcttccatcctgtgctgaggaggtgtgtcagttataaacgcattgcctctcagagctgaatgcaccctcccatgtatgctgtctgaagaacaagagctttgaagtgagcgcgatgttgaactatctcagtagagggcgctggagggacatcgtgggaggaaaaaggtctgcagttttcctgtcctgcgtccataggtggtatgactgtgaggacatttgttggagtcctaccccagccacggacccagagcgaagttcttctgtgacctcacagccacagcctggccataacctttccacagccctcccaacaaggaacccagagtccctgcacacggacctcagtgctctggaggcctcctgcctgtgcctgccctgactcccaccatgcccttgccacacgttgcaggttgccctcctcacctgcactgggaggcggcctattgcagctgcagaccagctgaggcctgcacaccttagccaccttctctgcaagctgatgtgctgaacctcaccttccccttccaagcttgtccggcaccctccc

SEQ ID NO: 1175 - DNA, 34651 bp, Homo sapiens
ataagatgattacttaattgccttgttaaatatacacatctaagtctaaaccagcatctgtacttatcagaaagctggatttttccagagtgaaataacttctgtaaatacaaaatttaggccattgtttctctctcccacttcaaattatgctgagaggtcctagagtcctcagaggtgtctcaaggtatgagaaaacccaagttggtaaataaatgtaagccctctcaccattttcatctgtgtattaaggtaccatggaagactgaacttctaaaatgtggttctctaaaaaaaacgatgcttaagaccattgacatcctttcttattctatgatttctattctcattctaagatgttggcatgtgcccaaagtgagctctggatttttccctgccattccaatacctgtaggtctctggtagttcttaggcccttctgtccatatgggttaaggcagcatgatattcctcaactccaaattgtaatcatttatttgtttgttcagcaattccatatttatctttggccagggtgtacagaaaacagtgcagtctgtgttcacaagtctattctcatgctgctaataaagacatacccaagactgggtaatttataaagacaaagaggtttattggactcgcagttccatgtggccggggaagcctcacaatcatggcagaaggcaaaaggcacatcttacatggcatcagacaagagagaaatgagagccaagtgaaaggggaaaccccttataaaatcgtcagatctcatgagacttattcgctaccacgacagcagtatgggggaaactgcccttatgattcaattatctcccaccgggtccctcccacaacaagtgggaattatgggagatacaattcaagatgagatttgggtggggacacggccaaaccatatcagtcagggcttacaggatacactgcaaaagagatgtgcacagaaagtttattaggcctgcccttgagatcaaaccatagtggagtataaaattggattggcagagggagacgttcacctgagatgctaatgcaaaaaaatgccttagtaaatcttgtgataagttctggaaataagatgctcctttaaaattatctggccttgagtccagggaaccagactttttttttttttttttttttttttttgagatggagccttgctgtgttgcccaggctggagtgcagtggcgcgatctcggctccctgcaagctccgcctcccgagttcacaccattctccagcctcagcctcccgagtagctgggactacaggcacctgctaccatgcctcactagttttgtttttgtatttttagtagagatggggtttcaccgtgttagccaggatggtctcgatctcctgacctcatgatctgcccgcctcggcctcccaaagggctgggattacaggcgtgagccaccacgcccggctagggaaccagacttttataccctcacattgtccagttattgcccaaggatggggatgtaggaagggaatgcatgatcttggatgaggcattctctgccgagggcaattcccagaaaggattgtgctcagaaccagagcctacactcccagcagctggggaaatgagtccctgagtccagaagaggatctaggtggtgcacatagcctccactatagttcacctttcactgctcagtgataagctctggaaatatctcctccagattaggattggtctcttcctgggaaacctgaagaagattagtgggttaagtatacaccctgccattacagctggtctcagccacagctgatgtcctcctctcctacccattctagatttccctcaccctcagctagcacctctactgcccttgatggcttacacaggccctaatatctgagagggtctaagcccttggtcactttgcctttctatgactggaagctacacttgtttatttactgtcaaaactggacaagcatgtactaaaagatccatcacaaataacctgggagccaaatgtattcttccttggccctatctcctccttgagactagagtcaagtatccctgctgtataacttctttccttaactactggtctcttgacaagataagctcaaagtgactaggtggaagctatagtgtaaaggtgaatgggtctcttcctgtgtctctggtggatgtattcccctcctgcaaatgggaacctctaaacatccaggtctcagagttggcaaggatgagaaacacaaatcccccaagtgggtcactgggaatgatggtgagacacttatttccacacttagttccatgaagggcaacctattattatctattgctgtgtagcatattaccccaaaacttagtagcttaagacagcatgtatttctttcttttttgtgtctgtgtttgtttgtagacacagggtatatcaatgttgcccagtctggtctccaactcttggcctcaagtgatcctccctcctcagcctcccaaagtgctgggattataggcatgagccactgcacccggccaacaagtatttgttattgcacagttcctatgggtcaggaatgcaggtgcagcttaactagatccctgtggctcaagatctttcatgaatttgctgtcaggttgtttgaccaagactgcagtcgcattgtaaggctcaaatgagagaaaattattttccaagatcactcacatggttgttagtaggcctcagccccccttcacatgggtctctccacagggatgcctcacgttatgacatctggcttccaagcaagcaagcaagccaaaagacagtgaaaaagaaagcatctaaaacaagtcttataatttagtgttagaagggacagcctatcacttctaccatattctgtttattataagtcagtcaataagttcacactcaaggagcagagattacacaaagatgtgaataacaggagtcagggatcattgagtctcatcttagaggctgcctgtcccaccatgtttgcagggtatcatctccaagttggtacctcaattgtatcttcaaaggtcattccattatgctatcagactggcagcttctagatgttacagagtgtgataataccactagatacccatgcttagtatctgtcttagtctgttttatgttgctaaggcagaataccacagactggataatttataaagaaaactttatttagagttccggaggctgggaagtccaggagcatggtgccagcatttgaagagggctttcttgctgagtcataacatggcagaaggacaagtgagcatgagaaagaggaagagagagagagagagagctgcttgtgtaacaagcccactcttgcgataagtaacccatttctgcaacaatgacattgatccattcacctcttaatcacctcttaaagtccctacctctcaacactgttgcattagggattacatttccaatgcatgaattctgtggggacacattcaaaccatagcattcactcactgccaaatcacctttgatgtaatgtgggtaccttggtctaatgagatattatgcaggatcccatgaaggtaaaacaaacactttaagccctctgatagtggtgctagtttaggtcttgccctattttatatacaatacatgtcaattctagtcatccagtggttgggtggttttccagttgttttccttagaagcctctgaccaatcatccaagccatttaccatcattcatgagtttgtatgtattcttctcttgggccacttctctttccacacaaagtagatgatcaaatgcattgcctgaaactgcccactgggaccaatttcccttgctgctatcatttagggccaccctgagaagagctgcagagcagcagttttgcaattcctgcttgcacttacctactgaattgacaaaaccaaacttgagggttttctttttttctctttaagctgactataagagactccttggacaaacatagggataaattcagggagaggtgctggtgcaatattagtgaataatatgggggtctgggctacctgcttgttcccttaggccctacttgtgcacaattctcaacgtaccacttccatcttgtagattgctgctgggcctgctcaaactcatgactttcaggatctaatagaactactcgaaatgggctatttcaagtagttctattactcatttggtcacctcccaggaactttgtgtaaaacttcattgcagatgaacttacattgtaattctcctattggagcttgccacaaaacatctttgtgagtcaccaatacctcttaccagaaggtcttctgcttagtatcaaccaagtggctgtggggccacttgccccactgcctggacctgcagggtcctttcctgctctaatatctgctcaaagtcagcagactttcatgttagtcagtatatgggttgcagcagtattcctaagtatggaatatgctacctcagcatccaaagaggcctaccaggcattgtgcttctttcttagtggtgggaggtacaaggtgcaatattttgtcctttaatttgcaggggatggaaaatcatgccccagacctctggatccctaaaaaaaaatctgactgatgggtaaactgacattaatctaccctaacaaatatattacttctgtctcagcaattacaattacagctacaacttggttgaattcatggtagtcttcagactggtttttgtaggggccagagaaataaattcaacagggatattatgagaactgctggccctgtaccctttaggtttcttttcttttcttttcttttctttgagatggagtctcgttctatagcccaggctggagtgcagtgcagtggtgcaatctcggctcactgcaacctctgtctcccagattcaagcgattctcctgcctcacagccccctgagtagctggggttacaggcatctgccaccatgcctggctaatttttgtatttttagtagagacggggtttcatcatgttggcccggctggtctcgaactcctgacctcagatgatccaactgcctaggactcccaaagtgctgggattacaggtgtgagccactgcgcctggcctgtaccctctaggtttctaagggtgtcaccaatcagggttattcctacccatcacatgacattttttttactacattgacttggggggaagcagaaagactttcacttagtaacttagcatttcccactacaataattcctacctcagatcaaaaactaatgtgtgtccaggcatggtggctcatgcctataatcccagcactttgggaggccgaggtgggtggatcacttgaggtcaggagttcgagaccagcctgaccaacacggtgaaacaccatctctactaaaaatacaaaaaaaaattagccggccgtggtggcgcatgcctgtaatcccagctacttgggaggctgaggcaggagaattgcttgaacctgggaggcggaggttgcagtgagccaatatcgtgccattgcactccaacctgggcgacaagagtgaaactccatctcaaaaaaaacaaaacaaaacaacaacaaaaaacctattgtgggagtactatcaatttccaaatatgtccattccaattatacattcaaagagcaaggaaatgaccacttggtaggacatggaccaagtgggctcactgtgagttagagctgggccagaactcactctatttatttctagccttcatgtgtctttaactctgatggagggtccatgtttacactttgaataccagtgtcatcttgaatgttgtattccacaatcttcaaaatgtgtggatattcctctgtctccagtgtatggttccttgactaaatgtccctagatctctgtgggaaatcattactatacacttgccatggtattataagatccttcctcctgaggacccgatttatcttttactcagtgggttctgagtccagaaactgaacaagggatggtgaccctagatattcatctggttgcacaaagggaggtcccaaggaaaacatgtgttgccttacaaggtagaagcctctgcagcatcttcaagccaagttgagttctagtctccaacagagaggaccaaaccatttctgcaggcctggagggttcaggaggatctgggttttgaggtttccaagtatgttagcccattaaagacttcatttcagtctcaggatctcactttctcttggcttgctgggactgagaattcaacattctctgtgatgcattttttttttgtttttggcaagacagggtcttgctctgtcacccaggttggagtgcagtggcgtgatcatagcttgctgcaaccttgaactcctgggctcaagtgatcctcccacctcagcttcctgagtagctgggactgcaggcacatgccatcacacctggctaactttttaattttttgtagctatagggtctcactatgttgccccggttggtcttgaactcctgagctcaagcaatcctcccaaagtgctaggattagaggtgtgagccaccacacctaaatcctcagccttatcctcagcttttactgccctttggctgtgggaaatgaaagcctctttatatgctgccaaagaggcctctgactttatcacttcacctgcaatggctgattggcagtccagtctttcatcttctttctcaaattcatcaatagcacccaggaagaggcattgtccttataattagtagttcccctgaatctctcaaaatcttgagataatgcacctgccaatttattcccttccaacagtatcccctcccaattcaacaccaggcaaaaatttaacaattgtgccattacagtttgccaagggatattaatgttccattactgccagttatgaggtccacattgcctggtaatccagtgccaaaagtctttttagagtttaattcctctatcccctactgatacaaatggtgttaggtcaagtttctaacagaatactgggaaaagacactgaaatcaagatttatgtgcagaaagttcattgagggagtgccctctgcatcaatatctgtgggagaattaagtaagtaggtttgggcagagggatcagttgaactgtggcacagtcacaataaaggcctcagctgaccctactggcacctctgcagctggggatgaacctttagagtcatcccaagttgaagcaagggggctgagccttcatatccccagttgtgggcaagtcatttgttgcaggctagcctttatctcttaggagaggggcagaaacgtggctaaggcaactctcttcagctgagagcaatgcctggagaggcactcagctgagagtcatcaccaccaacactcccagcagtgggggaacaactgcctcagctggaaaggggatgtggatgggagcaccatagcatccactgcaacatgcattattttaggtgttgagatacggcagtgaacgtggtagacaaaaatttgtgctttttttctacattttagacggagtagtcaaggaaggcctcgctgtgcagacaacactgagcaaagacttgaaggaagaaagggaacaagatatcaagatatttgggaaaagcatattccaggcagaggtctgagcaaatgcaaagacctgacctgaagggagaatatctctgggtgttcaaggaacagtaaggaggccagatggttgaaaccagctgagaaaaaggtgagtagtaggagctgacagatcaaagaaatcagggtggggggaagaaggcagattgtatcagaccttgaaggccattgtaaggtttttggcttttactctgtgaaataaaaagccatggcgagtttggagcagagtggtaacatgacatgtttttaaaagagtgctctggctgcgtgttgcagatagattgaaagagtgaccaggatgaaagcaggggaccagataggcttaatctatgccaaagataacggtgagttggaccaggatggtaacagtggaggtgataagaagtggctggattctaagtataactgaagagtagagctgaaaatccactgctgatggattgaatgttagtttgagagagagtgaaagagataagacaaagatgacttctagatttggcgcttgtgctgctgaaagtgagggaagagagagtccctctcatattgttttatactcagtacctgttttaagaaaaaacaacaaggaagtaaaatcaaagacaggcagcccggtgccaggcctgaaaccaggcctgggcctgcctggcctaaacccagtagttaaaaatcaactcataacttagaaaccgatgttattcatagattctagacattgtatagaagaacattgtgaaactccctgccctgttctgtttctctctgaccaccggtgcatgcagcccctgtcacgtaccgcctgcttgctcaaatcaatcacgaccttttcatgtgaaatctttagtgatgtgagcccttaaaagggacagaagttgtgcattcggggagctcggattttaaggcagtagcttgccgatgctcccagctgaataaagcccttccttctacaactcagtgtctgagaggttttgtctgtggctcgtcctgctacaaaaggatggggttgccattaacagaaatgaggggccaggcacagtagctcatgcctgtaatcccagggctttgggaggccgaggcaggtggatcacttgaggtcaggagttcaagaccagcctggccaacgtggtgaaacctgtctctactaaaaatacaaaaatttgccaggcatggtggcacatgcttgtaatcccagctacttgtgaagctgaagcaggagaatcgcttgaaccccagaggcagaggttgcagtgagccaagatcgtgccactgcactccagcctgggtgacaagagcgaaactccatctcaaaacaaaaaacaaacaaacaaacaaacaaaaaaacaaagggctgggcgcagtggctcacgcctgtaatctcagcactttgggaagccaagacaggtggatcacatgaggtcaggagtttgagaccagcctggccaacatggcaaaactctgtctctattaaaaatacaaaaattagcccagtgtggtggtgcacacctgtaatcccagctactggggaggctgaggcaggagaatcacttgaacccagggaggcaggggttgtagtgagccgagaccatgccattgcactccagcctgggtgacagagtgagactctgtctcaaataaataaataacaacaacaacaacaaaacagagatgagggagacagctgctggaacaggtttgaaggaggtgatcaggagttcagtcttggacatgtcgagtttacatgtttattgtttatattgaggtgtcaagtcagcagctgatatattggttgagttcaggagagagatctgggctggagagacagattgatgaatgtcatatcctatagatggcattgtaaggaacatggctgtgctttggtcaaggataggctgaggtaaacatccagagcgactcagtgagtttagagcacaggcatataactccacttgttatcacagccatgtagccataacatgggaaggttcatcatttggttctaagccactgttgtctgtaaaaggtataattgccctgctgacactgtacaggcatgctggcacctagagaaagagaaccaaagctgtccattttgcagacagacagcaggaagccagggcacagcatggctcagcttgtgcccagagagagaaagagttaagctgctgaccctgaggcaggggagagctggccacacagctgtgtgggagccactggactaagcagctgagacagggcagacagtgtgagaaagttcttgatgagagctgctgctgaataaaatcatctttcacctgcctatagcctcccaagtgttcttgctgctcatccacccactcccttcagacctcagcatggactggaacctgaccctgagcatgataagtggtgtagttatgaacctgacacgcgattaagtgatgagactagatgcaattaacagggaaatgagtgtagagaatagaagagattcaagggctgaggcttggatgctctgctgttatgagtataggaaaataagaggaaacaagcagaggggtctgagaaagagttgccagtgactttggaccaagcgagagggtggtgacctggaaatcaatgaagacaatgcttcaaggaggagtgagttatttcctgtttcaactaactggtagaaaacatacaaccttgatagccagtttggtgactgagtgatacgagacatgttttttaaagtggatttgacagagaattgaaggaaaggaattggaggcagtgaatatagacaaatctttcacaagcaatttttgtgtctttgttttgtggtggggaaaagtgggaacaagagaaggttttaagatgggagaaataacatgtttgttcactgatgagaaagatcgaacagagagggataatttgataataaagagacgggagaattgttcaaacgaagacctcgagtagatgagagggaatggaatctagtgctggagtggaagggttggcccctgaaaagagtgccaatagttcatctagagtaaggtgagaggagacagagaacacgggcacaaaggctggaaggtgggtaggtgtggtgaatgtggaattctcttatgattgcttccattgtcctcagctaagaatgagaattgggaagatgtgttggaggtttgaggacagaagagaaggtatctaggcctaggatgagcacacacttacagctgcagtcatgaatttaaaggaagactggctatcagggttgtatgttttccattagccacatacagctgcacaggtgcaggtgctgagtgggtagagaagtgaatgtcacctgggttggcactcaaccaaccaagttcagagactcaagagctggtcaagggagctgatagtacacttgatggactcataaccccaccttagtgctgactctcctttatctcatatatgcatatatgtctagaaaaaattatattggccttagacattttgcagagactgagaataaccgagtcacattcgtgatagcgagctagtgcaatagctttgctgttgtggggatgacaaggtaatctagttcctacatgtgcctttggggttccagttcaattcttcctgtaaggcccatgagggtcacccatcctattctttcaagaggatcactatctcctttttgtttgtttgtttgtttgtttgtttgttttttgagatggtgtcttgctctgtcacccaggctggagtgcagtggcatgatctcagctcactgcaacctccgcctcctgggttcaagcaattctcctgtctctgcctcccgagtagctgggattacaggtgtgggccaccacgcccagataatttttgtatttttagtagagacggggtttcaccatgttggccaggctggtctcaaactcctgaccttgggtgatctgcccgccttggcctctcaaagttcggagattacaggcatgaaccaccatgtctggactcactatctccttttttgccatgagtatcccccttttttgacatgagtatcttttgacatgagtatcctcacaaccagcccctatcgtttgagataatttcaaactatttttcaagtaagaatctaagagagcttttggtgcccccaatttgttttaaaattagtaacgacatcttgtagttggatatttttctattgcttctaaagtatgcattttcttcctttattttacccatatatgtatttggtgagtggaaaatgtggttgttaaatgtatggactttggtatcaagcagaccttgttttgaatcatagctcattacatcttatcctcccaaatagcgaatttcttctattgtggtttcattatcatcaatgtaaagaaatagactcttttattgttcaactgctttattactaggacttctccttgtatgaaatgtaagcttcatgtttagaggtcaggattcaggaacatgtttcagctaagcatgacacatcctaaaggatggctagtgtgggaaatagtgatttttcctggattgtactgttgtcaatcactttcgacgtatctgaactacaacagactccctgagggttcctggctaaagctcagattttgtttcaaaagccattgaactaaaacagcaacaaacaaacacacacaaaacagattatttaaataaatcaaggccgagcacagtggttcatgcttgtaatcccaacattttgggaagctaagatggacagatcacttaaggtcaggagttcaagaccagcctggccaatatggttgaaccccatctctactaaaaatacaaaaatgtggcaggcacctgtggtcccagctactcaggaggctgaggcacataatcatttgaacccgggaggtggagattgcagtgagccgacaccgctgcattccagcctaggcaacagagcaagactccatctcaaaaaaaaaaaaaagaaaagaaaaggaaaagaaatcattacagtggctgtatatcttctgaaatttgcatacaataattgcttctgacatattcaaaatatgtaagaagcccctccaacatcagactccaagttcttcagttttgggattcagactggcatttcttactcctcagcttgcagacagcctgtgggaccttgtgatcatgtgagttaatatttaataaactcccctttacatatatatatatatatataacctatatataaaatatatatatatatatctcctattagttctgtctctctagagaaccctaatacaggaggacagggcttaccttcattccattatatgaaggtgaggactgaactctgatttttatgctgcccaaattcctatctaaggtgtctggggcatcgtgtcctacaaatcataaattctcatcagatgggttttatttaacattaatcgtgacttactctccaacctgactctggcataatattatgagacaagaaagaaaatcaaaatattttaccccaaaacatgtttctttgccatattttgaaatggtcatgcaaagctgttctttttgggggcaaatttgcatctgtaaagaatctcaattaacatagctagatatttttcttccagaccctcccaatcctaaagagattaactgagatctgaataggaaacatttgtcatctattgtctctaagggcagccactataagactttgaaagaactttggcctccaccatcttttatcttaacctgaacattccctttccatcaatcccaggtccttagaaaactcaaccaattgtaaaaaagaaaaattttaaattcacctgtagcctggaagctccccctccactgcactttgagttgtcctgtctttctgggcaaaccaatgtatttctttctttttctttctttttttttttttttttgagacggagtctcgttctgttgccaagctggagtgcagtggcgatcttggctcactgcaacctctgactcccgggttcaagcgattctcctgcctcagcctcccgagtagctgggattacaggcgagtgccaccacgccgggctaatttttgtatttttagtagagacggggtttcaccttgttggccaggatggtctcgatctcctgacctcgtgatctgcccgcctcggcctcccaaagtgctgggattacaggcacgagccaccgtgcccggcctaccaatgtatttcttaaatgtatttgactgatgtctcatgcctctctaaaatgtataaaaccaagctgcaccccgaccaacttgggcacgtgttctcaggacctcctgagggctttgtcacaggtcatggtcactcatatttggttcagaatctcttcaaatattttacagagtttgactgttttcgttgacaaagggaaatagctgtatttatctacgtatatatagaccttgtgtagaccttgtttttaatcccagcttcattacaccttatcttcccaagcagcaaatttcttctatggtgggtttttttttttttttttttgagacgtagtctcactctgtcaaccaggctagagtgcagtggcgcgatctcggctcactgcaagctccgcctcccgggttcacgccattctcctgcctcagcctcctgagtagctgggactacaggcacccgccaccacgcctggctaattttttgtatttttagtagagacggggtttcgccgtgttagccaggatggtctcaatctcctgacctcgtgatccgcccgcctcggcctcctaaagtgttgggattgcaggcatgagccaccgcgcctggcctctgttgtggttttattatcatgtaaagaaatagactgccgccttgaattcctggcctcagcctggtgggaggatcacttgaggccaggagttcaaggcagcagtgagctatgatctcaccactgcacttcagcctgggtgacagagtgagaccctgtctcaataattacaatagtaataatacattttaaaaattaaaaaaatgcaagaaaggcaaaattaaggattgtttgcaaacattttctcaaccctcacaactgccctagaagatactattactcctcttttacaagtaagaaaaccaaggcttctagaggttaaattacttgcccgagatcactcagatcaaaagtgggagttgcacaatcaactcctttaatttcagagctgaaacacctgccagcatagaagaagtgctgtgaattatcaggaagaggtgggatcagtgattattgatggcactgggaggaggggcgtacgtgaattagctttttaaaaagtagtcaataaagagactaggtcacaatgtgtttactagcatctgagatagcgcttccccattgctcacatgacagaaagctcttcccctgctctgcccccaagacccatcctctccctgcgacatctgtggagatttctcaaggacacggctccaggggtaatttgtttcagctgctgctttctaagggcgcaaatcaatcttattaacccaagttcctgagagagactgactacaggaggttaaaagactaaaggggaggaagttgacgttggtggtccttttttcgccttttctcttttcaaagagatgaagtagctggtatgtgggtacagagtatgtcataaggatatttcttagcaaatccatgagttggtgcgtaaaagcagttatatgctaagctgacctgggactaaaaggtaagtcagttgggcatccttataagaacaaacctttccagccaaaagatcaagctggcgagctctggctgttgcaactcatgctctagaatggcagtcaccacgtgagtgtgacctggtgtctaggaatgggaattactctaattcctcttctgtttcttgggagatgacttggctctgtaatggagataatatagtctttgaagtcaaacagacctagcttcaaattctagctctgtgactcctgaaaagctacctaatttctctactgctcagtttccccattcgttgaatgaggatcataatacttaccatgtgggtttacggtggttatcaaataagatgaagcaaaagggccaggcatggtggctcatgcctgcaatcccagcactttggaaggccaaggagggcagatttcttgagctcatgagtttgagaccaacctgagcaacatggtgaaaccccatctctacaaaaaatacaaaaattagctgggcatggtggcatgcacctgtagtctcagctacttgggaggctgagactgcagtgaaccgagacagctctgctacactccagccttggtgacagagccagaccctgtttcaaaaagaaaagggggtggggggcaacaaagtaaaaggacatcccaaggtgaccggcagtaaatgggtggccgctatctctgttatcaaaatcaaccctccagtctctatgccatgtgcatatctggacaagtagcatggctcccagctgcagccttatttatgtccctttcctgttctttaaggggtaagtgttccaggaagaaagctttgcacatgtcagtgaggtcaaacagccctgtgagaaaagggctcctctggaatggcgccattagagaggaaccagcatgagacagggctgccgtgcaacctggggagattcagttcacctatctgtgcctccattccctcagtgttatctgggggtaatgatagctgcccactgcatgattggaataatcacatttgttctatataaacaaccaacaagtactttactcttagccgcccactcctcataataggtatttgaggaaatatctgcctcttgaccttggggggaagggggatgaaggccaggctgtagggaggaccaactgagagtaaggcagtgaatgttctctgcaaactgcgccattctggacctagctggagcattcctgacccctgaagcatgtgtgccagctcttgtgttttgcattcacaggtgcagtaactttaaattcctcaaatcccctgagtgcaaggccatggctcagaaaagccttgcaaacaacagcattaatctcccctacaaggacttgacctccgaggtaaccaggcgccgagtcaccatgatcacaaggtacccaaaatctttcctctggatcgcttgtggggttgggacggagcataacactgagccccagcaagtgcctgaaactgtagctggcactggtttatttaaatgtatttaatgctgctgcaagacacatttcacagaaaaggaaactgctttgtcatccattgtggaaaacagacttttcccacatggcccttcaaggggtgatgacacccatttgtgtatgttcactgcgtgggtggtcgtggctcttgatagagagtggggagtggggatcactttgtttggtttggttttgtttttttgagacagggtctcgctctgtcacctgggctggagttcagtggtgcaatcacagctcactgtagcctcagcctcaagctcctggggcttaagcaatcctcccacctcagcctcccaagtagctgggactacagccatgtgccaccacgtctggttaattattattattattattattattatattgagacggagtctctctctgtcgcccaggctggagcaatcttggctcactgcaagctccgcctcccgggttcacggcattctcccacctcagccttctgagtagctgggaccacaggcgcccgccacgacgcccggctaatattttgtgtgtgtgtgtgtttttttttagtagagacggggtttcaccattcacaggatggtctaaatctcctgaccttgtgatctgcccgcctcggcctcccaaagtgctgggattacaggcgtgagcgactgtgcccggccagtttttttgtatttttaatagaaacagggttttgccatgttgcccaggctggtctcaaactcctgggctcaagtggtccacctgcctcagcatcccaaggtgctgggattacagatgagagccactgtgcctggcccaagatgacacctctagcttgagctctttgtcgggtatgttatgagattaaaaataataatcttactaaatctgataagaagttggtcaaaaaaatcaaaattattgatttgaaatagaaaatacagacttccatctaatgttgtttacaatgccctttgaccttagagtttattgggatgtaagattccagcaaattgataggaattaggtgccatttcttagttaccatatatgggaatgtcaaatctttgttgatagtggtgcacagccaatttgataccacgggtttagaccgtgagagtgggcattgtctgcaggaagtgtggtccctgtgctctaatgtccatccaaggacgagatggcataattctgtggcctgtcctagccaccaaacaattcccttcccatcatcccacatcctctcagcaacattagggatcagctttgattgggagatgggagcagtgaacttgtggccagattgaaatttaaatttggattccagttctgccttctactggtcacatgatctgggtaatcaccttctgtctcagcttgctcagctgaaagatttaatgtgggggctgagattctacatgtggttagtttctaggtaatttctagtccctggaacatagtaaatgttcagggaacaattaaatctgaacctgtaaaagcttgacaggctagtcctatgcccttgaaggcaaggtttgcccagccctgaggaggatggggagactctggtatactccagcagaaggggaggcgaaccccacagcctggggatgggggcaagttaggccaaagggagctgtgaagtgaaactgaggctggactggccctgtgaatagctggaatgcaaatgaaacgtttagacacagcctgtcccaggctgaaatgtacagagagctggccagtaggggatggagaaagctaattgatgggaagaactactgctctaatcctaagatacccttggaggatggggatggaggagtgagggtgcagactctaactctgttgggtccatggcaccaacggggacagctgagctcactctgaggagagctgactgacaattaaagtatatctcatttctgcaaggtgagtatgggtggaggagcttggaaagatgtcctctgaaatgttaactattctttttagatgctggcatctggggtatttcttttgttccttcttttttgttgttttgagacagggtctcactctgtcacccaagctagcgtgcagtggtgcaatcatagctcactgtagcctcgatctcccaggctcaagtgatcctcccaccttggcctcccaagtagctgggaccacaggtgcatgctaccatgcctggctaatttttattttcttgtggaaagggggtctccctatgttgtccaggctggtcttgaactcctgggctcaagtgatccttccacctcagcctcccaaagtgctgggattacaggcatgaaccaccatgcccagtctgtttccttttcctctgtttatttaaaaccctatctttattcaaatggcattcaatgtgcctttcttcctagaaaagagataattacccagaaaagtgatgaagctaaggagatgctctcccacttggatttggagcaagcccctccccctcacaggacctacctcacagtacctcctgccccacctccttctccagctgaggatcccacggtctcctaagatgtaaaacttattttgaagtgaattcttacacagaactccagaaaacagtttcagtggcattcttgaggtttgtcttagaagactcttgaagatctttgttctttcctatttttcttcacctagaaccaccatagagcatggtttacccttgctaatagacttagtcatttttggttttttaatccaagtctctgatatgatatgcatatattttgatctttatgttatgctatagaactgttgctgtagtcagttgtatttaaattaataaacagttatcaggccttgttgtttattactaaatctgaatcagtgaaaagtctaggccttttaaagtctagagtttaaagatctcaggtcctgggaaccctgaggtagctggattttcaaaacgcaacctgagacactacagttgtgtggccctatattttggagctgcattcccatgccgtgtgctggggctaaggtggttgagtttcacatttattgacagtgtttttaaagtttgtttctgggagatttgaagtgattttcaaactctgtaacagaaaactctaccctgaaaagcagccaagtgtagagtggttctgttgtggagaagtccattgcttgagtcctctccaagctccttgacgggccccagtgcacctctaaggacttccggggctcttctgaattgttcgaaggcatcaaaaatgtgataattctggcatacatatacatataaaaaatatccccacatgtcatcctttatttcgtctgctgcttcttagagtccttgtaggtgttctgtctccaggcctgcccttgtaaatgtgctcggctcccctatgagaaaggagtcaaagcttctgtacaccattgtggagtcagggtaaacactctgtgatctcccctgatcccatgcatttaataaaaccaatgttccttctttaaaagtaaaaagtgctccggttcttctacccccatagtagttggctgtgccattggtgtggaagtcggactccttacctgtggccttcagcagcatggggcagggaaggagcctgcactgagtgtctgccattgccagctggatgctggacatacacatctccctctcctcagtctggtgaagaatgggcctgcgctgtccaataggacaaccactggccacttgtgactatttcaatttaaattcattaaaaatgaaataaattcagttcttcagtcatgctagtcatatttcaagtgcttagtagatttgtgcagccagtggctaccctatgggatgttgcagttgtagaatgtgactgccattaaagataattctatgaggccgggcatggtggctcacccctgtaatcccagcactctgggaggcagaggtgggtggatcacctgaggtcaggagtttgagaccagcctggccaacatggagaaacgctgtctctactaaaaatataaaaattagctgggtgtggtggtgtacacctgtgatcctagctacttgggaggctgaggcaggagaatcgcttgaactcgggaggcggaagttgtggtgaactgagattgcaccctgtgcttcagcctaggcaacagagtgagactccatctcaaaaaaaaaaaaataaataaattccattaaacagtgatggggcagaggttaaacatgtccaaggacacaccgccagttagaaatagaatcaaagagaggtcaggctgggaaagaataattcttgtgttttacttccatttggtttctgaacacattctaggatgttctctctgttcctttgttcagcaaatgttgagtacccactatgtaagcacggcactgttctagggatatatcactgtacaaaacaatcaatccctaccccatggagtttacattccaatggggaaagactaacaaaaaacatacacaatgtaagtccaggtgcagtggctcacccctctagtcccagtgctatgggaggccaaggtgggcagatcacttcagctcaggagtttgagaccagcctggacaatgtagcaacctcatatctacaaaaacatacaaaaaaaatttagctgggcgtggtggtgggctcctgtagtcccagctacttgggaggctgaggtgcaaggatcacttgagcctgggaggtggaggttgccataagctgagattatgccactgcacttcagcctgggtgacagagtgagaccctctctcaaaaacaaaacaaatacacaatgaaaaaacagtgaattatacatcaggaggcgatgagtataatggaaaagatgtgttaaagcagtgaaacagggtaagggagattagaagtgcaggttggttgtagtgttaaacagggtggtctgggtaggtgtatgactccattttaatgccactgataaaggcatacccgagactgggaagaataagaggtttcattggacttacagttctacatgattctgaggggagtcctcagaatcatggcggagtgtaaaaggcacctcttacatggtggcagcaagagaaaatgaggaagatgcaaaagcagaaacccctaataaaaccatcagatctcatgagacttattcactaccatgagaacagtatgagggaagctgtccccgtgattcaaattatctctcaccaggttcctcccacaatatgtgggaattatgggaatataattcaagttgagatttgggtgaggacacaaccaaaacatatcgttccatccctggcccctcaaaatctcatgtcctcacatttcaaaattaataatgccttcccagcagtcccccaaagtcttaactcatttcagcattaacctaaaagtccatggtccaaagtctcatctgagacaaggcaagtcccttccacctatgagtctgtaaaatcaaaagcaagctagttacttcctggatacaggagggtacaggtattttgtaaatacagccattccaaataagagaaactggccaaaacaaaggggttacagggcccatgcaagtctgaaatccagctgggcagttcaaattttaaagctccaaaatgatctcctttgactccaggtctgtaggacctctttaggaaggtggcatttgagcaaagacttgaagccagtgatgaagttaggtgtgtggacatttgggacagagggaagaactagtgcaaaggttcaaaggtagaagtgtgcctggtgcattcaaggagagcgaggaagcttgagtagagtggatcagggacatttgtgggatgaaggcacagtggtggaggaaggaggccgacgatgtggggttttgtaagaactctgactttgactttgaatgagatgggaagcagaagccatagaggttttcagaaaaagaggcatgatctggcttgtgttttaatgggattgttctggctacagtgttgagagtaggctgcatgggtagagggaacagaagcaggtcatctgctattgtagtaatccaggaacaagacgatagtcatttagaccgattacagttgtagtgatgagaaatatgggaagattctggatctacgtgtttgaagatgaaacctacaaaagctgctgatgcattggatatggggtatgatagacaggcgggtaaaggataactctaagatttttggcccaagcaactagagggattgagtttcctcagccaaaagaagagcagatttacctgggtgcaatggttcatgcttgtggaggctgaggcaggaggattgtttgaggccaggagtttgagaccagcctcatcaacatagggagaccctgtctctacaaaaaacaaaaacaaaaaaaaaccaagcacagtggctcaaacctgtagtcccacctacttgggaggttcaagctgcttcttgcttgagcccaggagtttgaggctacagtgagctgtaatttgccactgccctccagcctgggtgatagagtgagaccttgtctcaaaaaaaataaaaataaaagagcagatttggtgtgtctgatgaagaaagagaaggtcagatgttcaacctgctagtttgacatgcctaatagacatctaaatggagatgccaagggggcaggtgatatatgaatctggagttcaggagtaatgactaggttggagatataaacatgaggttcattagcatatgtgagttggaatttaaagccctgatattagatgagatgcccaaaggagtaagtagataagaagagaccctaaactgagccctggggtgcttcaatcttaagagggagctagcctgtaatctcagcactttgggaggctgaggcaggtggattgcctgaggtcaggagttcaagactagcctgaccaacctggtgaaactccgtctctactaaaaatacaaaaattagctgggcatggtggcaggcgcctgtaatcccagctactcgggaggctgaggcaggagaatcggttgaaactgggaggcagaggttgcagtgagctgagatcatgccatcgcattccagtccgggcaacaagagcgagacttcatctcaaaaaaaataaaaagtaaaaagaggtcgggattaaagggcggaaccagcaaaagaaacaaagaaggaacagtcaaagatggaggaggagtctaacattctgaaagcttcatgaaggaaaagtttttcttccctttgtttcttcttcctccaccctcttcttccatcccaaagcctgatgcagcaggttatggagagaaagaacaggagccatggggagggctgcacaaacaggattggctcatctcagcatctcagttactttccaccttccacttttcattcaaacacctggcaggtagaggtgcttagtaggatgaatgagctcatgcattccgatttctgggcttttcagtttttaagagtcagctgtcagtgggggagagtggttgacacccagatgttatgggctgaatggtgtccccacccccaaattcatatctgaaagtcctaatcctaatactttgtttttaacttttagtttttttagacagagtcttgctctgttgcccaggctggagtgtggtggcatgatctcggctcactgcagccttcgcctcccaggttcaagcgattctcctgcctcagcctgtcaagtagctgggattacaggtgtgcactaccacacccggctaatttttatatttttagtagagacggggtttcactacgttgccaggctggtcttgaacccctgacctcaagtgatcctcctgccttggccccccaaagtactgggactacaggtatgagccaccacacctagccctaatcctaatactttagaatgtaactgtctttggagataaggccttcaaagaggtgattaagctaagcttaggtcattagggtgaaaaagaggagatcgggacacagacatgtacagagggaagataatgtgaagatgtagagaacagccatccatctataagccaaggagagaggcctcaggagaaccaaccctgctgacaccttgatcttggacttccagcctccagaattgtaagaaaattaatttctgttgtttaagctatgaaaggaaaataaatcttggggtcccaaaatcactaagctaaagggaaaagtcaagctggaaactacttagggtaaacctgcctcccattctattcaaagtcacccctctgctcaccgagataaatgcatatctgattgtctcttttggagaggctaatcagaaactcagaagaatgcaactgtttgtctctcacctacccgtgacctggaagccccctccctacttgagttgtcccaccttttggacagaaccaatgtacatcttacatatattgattggtgtctcatgtctccctaaaatgtataaaaccaagctgtgccccaaccaccttggacacatgtcattaggacctcctgaggctctgtcacggtgccctcaaccttggcaaaataaactttctaaattaactgagacttgtctcagctctttggggttcacaaagccactctgtcagtggtatttgttatgggagttcaagtatattaatacaccagtggagagccattttgagatctcatcctctcccttctcactcatggcatgtgtaatcttaatgagaataaactcccaggggaaaagaaaagtcaggcttggtatggtggctcacgcctgcaatcccagcactttgggctgctgaggccagcagattacctgaggtcaggagtttgagaccagcctggccaacatggtgaaacccctgtctctgccaaaaatacgaaaattagttaggcatggtggcacattcctgtaatcccagctacatgggaggctgaggcaggagaatcaattgaaccccggaggcggaggttgcagtgagccgagatagcaccactgcactccagcctgggtgacagagtgagactctgtctcaaaaaaaaaaaaaaaaaaagtcagatttttcgctttgctttccaaagtatagtctttagaactcaggataggaagaattgtcttaaagccaaggctttgacttttaagagctgattctcttggaaatcaaaaggctgagctctggtcccatgaacaacaacctgagaagataggtgaagagtattccatctctacagtctgaataaagtctggaagaataagggaacttcagagagagaaagagagcttagaaattagccaggcctggtggtgggcgcctgtaatcccagctactcgggaggctgaggcaggagaatcgtttgaacccaggaggcagaggttgcagtgagccgagatagcaccactgcactccagcctgggtgacaaagcaagactctgcctcagaaaaaaaagagagagaaaaaacttagattctggaggtttcctgataggacttcatgtaccagataggttggggcaagagaaagcagaggagacttgtgctcatttccaggtgaagcctatggggtggcagacttctaggagaagtggccctgacccagcaggggcacagcaggagagcaaaagggaacctgtgttcctaccctgcaggacagctcccactgtgtcctcatatccttggtggtacacacaacaggctggaaaaaagctgccttggccaggcatggtggctcacgcctgtaatcccagcactttgggaggctgaggaaggtggatcatgaggtcaggagtttgagaccagcctgaccaccatggtgaaacccctgtctctagtaaaaatacaaaaattagcagggcgtggtggtaggtgcctgtaatcccagctactcaagaggctgaggcaggagaatcgcttgaacccgggaggcagaggttgccacaagctgagatcatgccactgcactctagcctgggtgacaaagtgagactcctcaaaaaaaaaaaggctgcctcatgggtctggccattggaactcagaggaccccaaatctgtaactggatacagagatgtggatgccagcagcaaagctggaatctgcctgatggctaaaatcaggtgtgagacactctgcctgggttcttccccctgagtgccagtgcgccctcaatctcacttgtctcaagcatagatgccacctcaaagacatggggagaggaaaagcctgaattggctgacaacacattgatgtgatggaatccaagctgaactggcaaatgaagtgttctaccattaggtacaatggcaactgaagagggaaattaagtttgttattaaaaaataatgcagctaggtgtggtggctcatgcctgtaatcccagcactctggaggccgagatgggaggattacttgaggccaggagtttgagacaagttggtcaacatagtacaatcctgtctctacaaaaaaatttagaaaataataatattgctataagggctgaggataatggagttattaatgggtgtattaataaccgtaaagtcaccgcactagccctgacttttcttttcccctggtacattaataacttgagttattaatgttctggagatgatggtcgtgatggttgcccaataatatgaatgtgtttaacactactgaactgtgcctttataaatcctgggatggtaaattttgttatattttactgcagttttaagagttggaagaacaaaactatgctataagctttctccacctgaggttgtggcttataaaattcatacccctgatgacagataaaaactgaagtggaggggctgggcgtggtggctcacgcctgtaatcccagcactttgggaggccaaggtgggtggatgacaaggtcaggagatcgagaccatcctggctaacatggtgaaaccccatcttcactggaaaaaaaaaaaattagccaggcgtggtggcaggcgcctgtagtcccagctacttgggaggctgaggcaggagaatggtgtgaacctgggaggcggaacttgcagtgagccgagatcgtgccactgcactccagcctgggtgacagagcgagactccatctcaaaaaaaaaaaaaaaaaaaaaaaaaaatcaaaagcaaactgaagtggagttagggtgaatagagggtgggttcaggggagagatggaaagattgctccggtagtgccgagagcaccaggagatggaggtgggaaagtgtggatgctgctatttgcttggcgtcatcctgggcagcacctcaaaaccaggcacaagcctctcagttacacacacacacacacacacacacaccacctttaacatcctgcaatcacatctcccaacctgaaggaattacctgatggttggaatctatatccttctcttaagcaaagattcccacaaagttcaaggaagagaacgttgggtaagaaaattttatttcacaatgtaaagggttatgtgagacccaactgtattctatctgaagcattagaagccaactgtagtaaatgcatcttacttatattcgatgctggccagaggagctattctgcttcctttagaagttatgctttttattgtggcttgtggtaaccatgtaacatgcaagagcaatggttttcaggaagaaactattatgccttacagcttttgccccaaatcacaagaaaacttgaactatgtcattaaacatcccataaatgctgacagaagataaaggatatttattatatgaaattgtctacgccctcagactacaattcctgaatagttagatggtgaccatgttcatccttctggattaatgaaaacttggaaagcagtcaaagctgcctgggccctggctggctggctctcccttcagcctgctccccccaggagccctgagcatctccttctgccattgcctgtacagcttggaggcttttcacatcttggagagcttgatgtcataagtgaccatgttcaagttgtcccaggcaaagagcttcttctccagggggttgtagtcaatcatgctgctgtacttatagcggttcttgaatgggatggtcagggtcttgctgatacctgtgcctgtgtcataagcaaagttgacggtagcatctgctgaggtgtagctgctgacggtgtacaaggtgccacagatgatgaaggcattggcgactgactgcttacggatgtttgtctcccaggtttgttcgagttccagattctctgggttcagtttggagaggacaatggcacctttggcctcatcggtgctgtaaatgacccagaggcctgcttcatccacagccaagtcaatgtccgtgtagccaccccaagaatacgggaactgtccgtggtagccagctccagggatttccttctcagccttcactgtctcggtattcagctcatatcttatgacagttctggactcagcgccctggaaatagaggctccccgagtacaccacagcacccgtgctttccagtggcctaggcagtatgtgaaccttagaagggtagccctgcataaactggctgatgaggtcatactcaaaaacctggcggacatccgtgccaactgtgtcgattctccacgtggtctcctgggtgtaggggtaggtgggcttggggtctcgcatccacacaccatacttgccagtaattgtttctgctgttctcagcgtgagaggctctcctacccaaactagttctccacatcctggtaaattcagaaaagaaaacgaagcaccacttaatccataatctttccaaacacagacaatgatcatgcggaagcttggcagagccagtagatgtgacagccctggagacaaatcgtctgggtttaaagctaggctctaccacccgctggctgtgtgactttcagtaagttacttagctctctacgcctcagttatcgcatttgtaaaaggggatactaatagtgttttgggtagtagggctgttgtaaattttaaatgtaattatatatgttaagtgcttggtatagagtaaatatatggtaaatgctatatgatcaatctgtgtttcatgttattgacaattattgctatcactgaggggcatgcatgggagtgggagctataaaatatttaaagtacaattcactcagtatcagttgtaaggatgaaagttgcacagagggcttcaactgcatttgtaatattctacttaagctgggcagggacccatgggtgttcattgtattacttattgtgactttcatgcctggtttatttcattactataaggtaggagagagaaaaatcaactcataagaataatctccatacaacaaagtttttcaagccctgatgagtcacatatttcatacatcattttaatataataaacatgaaaataattattttttgagacagggtcttgcactgttacctaggctggagtgcagtggtgcaatcacagtgcactgcagcctcgaccttccaggctcaagcacccctcccatctcagcctcctgagttgctgggactacaggtgcctgctaccacacctggctaatttggtttagaaaataattttttaaatgtagtgaagagacggttgaaaatttagagttaccagaatcacaacagatgtctgtattttttttttttttgagacagagtctcactctgtcgcccaggctggagggcagtggtgtgatctcggctcactgcaacctctgcctcctgggttcaagcaattttcctgcctcagcctcccaagtagctgggattacagatgactgccaccatgcctggctaatttttgtatttttagtagagacagtgtttcaccatgttggccaggctggtcttgaactcctgacctcaagtgatccgcccgcctcagcctcccaaagtgctgggattacaggcatgagccaccatgcctggtccagatttctctacttttaatggcaccttcggttccctcatagaaggtagaaacactttgctgctcatatcttagagaaccgtgttttaaatatttcataacccctacttgcatgcatgcccttcagtgctagtaatcattgtcaataacatggatagtcaaagtttctggaaatcacagtattagtcataaagttggactttcagggaacactttggagagagccaaactgtacttttcctaagtggccaaagttcagaaaacatactgttagtaacagattgtggctgagatggtgcttggtgtatacctgtccctaaaataaagatatgaaggcgctactgaaaaatgtaacttctcaagtatatctaattctacatgacaatcaagtggatgaaatcaacacatctctcatcttgccctgtgcagcccagcccagcctcccaagtgtgggtgataggatagagggctttgttagggaaaggctgactcctgcagacctgctctgacaagggaacagagagagagagagagttctgttcctcttctcctcccctccctctgctcccagggaagttaatttcccccttgggtgggcatttaccctatactgattctctgaacacagcactagacatgaataaagaccacgtgggcacaaaagggaagaaacttaacttcataccggtgtctccctctccactcctgagatagccagatgggctctccttcaaaattcgggaagcaggaacttcagttagctcggacttcagttcctggaaggccaaagtgtccaaattccacgtagaaactgcattaaaagaaagagacaaaattttactgtaagaaaaaatggcccaaggattgactatgttgaggatgacatttaaataggctgccggccaggcgtggtggctcatgcctgtaatcccagcactttgggaggccgaggcaggcggatcacctgaggtcaggagttcgagaccagcctggccaacatggtgaaaccctgtctttgctaaaaacacaaaagaattagctggatgtggtggcaggtgcctataatcccagcttcttgggagactgaggcaggagaattgcttgaaccaaggagggggagattgctgtgagccgagactacactattgtactccagcttgggcaacaagaaagaaactctgtctgaaaactaactaactaaataaataggctcccaaagatatggtgtttgagatttgattttagataaggactggggatgggttgggggtcagagaagggaagataaaacatgattggactgtgctgataacagttgggcctgagtgatggctacattggagttcattgtagtctctctacttttgtgaatatttgaacaattccataattaaaaacctcataaataataaattgcagggcaatgtgcctaccttagagtagggtattcaaaatcaaataatattttaattccactagaagggctggtttgtgaataggtgagtcgtaatttcaggaatatggagacagtcctcagcatcttcttagatgtctgaatttcaataattaaaaattcatgaaaaattagctgggcatggtggtaagcatctgcagtcctaggtacttgggaggctgatgtgggaggattgcttgagcccagaagttcaaggctgcagtgagctatgatcctgccactgcactccagcttgggtaacagagcaaggcccggtctcaaggtctcaaaaaaaaaaaaaaagagaccgggcacagtggctcacactgaaatcccagcactttgggaggccgaggcaggcggatcacttaaggccaggagttcaagactagcctggccagcgtggtgaaattccatctttactagaaatacaagaattagcagggtgtggtggcacatgcctgtagttccagatactcaggaggttgaggatcacttgaacccaggaggcaaaggttgcagggagccgggattgtgcaactgtactccagtctgggcaacagagcaagactctgtctcaagaaaaaaaaaaaaaaaaaaaaaaaaaaagaagtgtggctcatgtctgtaatcccagcactttgggaggccaagacaggaggagtacttgagcccaggtgttcaagaccagcttgggcaacatagggagactcctgttaaaaaaaaaaaaaagataaaagtttactgcatgacttaaggttttttcccttgttatatgcaaatattcttgtaagaagtaacatattaagctttatactttcagtagaaatattctgtctgattcctttctgagaccagttttgcataatggagagggagtgtgtgcagagttcctataggagtttggggtgggggtggtgagccatacagaagggaagcgggtgggcagcattggttagacagtaagtgatcatggtgtgctacatgtctctactcttgcttaggattatgatcttacagcagtcttgaatacaaggatgaggcaatagtcacaaggaacaggcttggctattttaaaatgcagtttggccaggcccagtggctcatacctgtaatcccagcactttgggaagccaaggtagacagatcactggagcccaggagttcaagacaaacctgggcaacatggtgaaatcccatctctacaaaaactacaaaaagttagcctgggtggtgatgtgtacctgcagtcccagctacttgggaggctgaggtgggaggatcacttgagaccgggaggtcaaggctgtggtgagcagtgatcgtacctctgcactccagccctggcgtagagtgagaccctgtcctcccctccaacctcccaaaaaacccatcacatacacataaaaacaaataaaatgcaggtttgatgattattcaggtgtggcaaggccaacatcccaggaggcaattgtcactgaaaagcaagttaaagcaaaattatggagacagtaaaaagatcagcagttgttgggtgaggaagggatgactaggtgaggcacagacgatttttagggcaatgaatactgtgtatgatactataatggtggacacatgtcactatgcatttgtctaaacccatagaaggcgcaacaccaaaaatgaaccctaatttaaaccgtggaccttgggtgttgtgcgtgctgatgcaggttcatcagttgtaacaactgctgtggcgggagatgatgataatcggggaggctgtgcatgtgtgggggccagtagtatctgggaactgtttgtacttttctctcaatttggctgtgaacataaaactgctctaaaaaaaaattatctttacaagttgttgtactcacagagcccaagaggaagggggcacactaagcccaggaggccacctggggaagcaccagggttgctccagaagagggcaccaggggaaaatgtgggaaagcgcctttattctttccatgggaaggaaagaaaggggaggcagggtaagcaggtttaggattggggagtttgaataatttcagcaggatctggggtcacaggagttatctctaattgtctggtaccaggccctgggtgattaggtcagggggacagtggccttgagtttgagccagatggaggtggtcacagggtgtgggctctggattggttggtttgcatatgaaagctgtcctcccaggtgagtcctttgctaaccgtaggaactggctacccctgggaggggcagtccctctcacgtttgcaaggcccagacagcaaagcatcagaataaaaagacatgcttaatacactgggcttttctcttgctgaacctctgagtcacttctctgccctttgagcaacttgttccccgctcaggattctcaggtgttcaggacagtgggaggaaagtcagtgcatcccctgaggccggagcgcctacacagccgagagggtcgggaagacatgttctgcctttgatcatttgtttgctcagctctcctaaatttagatttcaggcagagaggatcacc

SEQ ID NO: 1176 - DNA, 6290 bp, Homo sapiens
aacagaggataaaaggctcaatgaaaggataatctccatattagtgctaccaaagtgtcattaatttctatttgttggaaactttactaaggaatgactgctttgaggtaatggataaggacagagcttgaagggtcagcaattcagtcagccactggagtagttttcacatgaagtgagaagaaaagctgagatggagtttgtagggcagctggagttcagatctctcctaagtcctcttctgttcagatattttgtcacctgcagcaacacacacagttattgtcattcctgggttcagtactgtaagcccggacccatcttccccactccctttgcacccgagcttcccatttctctgccctgttcaggtcccagggagaaggtggtcatccctgcacatgccctggtcctccaggtgaagagcacataggagccaaggagttcacgaaagtcattgaatttcaccctcaaaccccagctgactgtgaggccatcccacatgcttcatgtctccaaaatatacagacaaggggaagggccacattactgagggcagagaagaagcttaaccctggaatgagaattggaagggacaaatatccaaaccatatcaatgacggcaatgaacgaaggatacttgctcacattgtgtatactgctctttgaaaggatttcaaaaaccaaggtaaattttctaaaatgacctctgttgaacatctgacagcagtacttcctccttcctgaattctttaattccttggctcatgtgacagcatattctcctaattcttctgcttctctgcttctccatttttgttaaatactcctctttggatgttttgttaatcatgtatctttgcattaattttgccttttcaagatatttcattaaaatatgatttattactgagttcttttggtatcccccaaattttgcacctaagccaggtgcatcccctacatcaccctagtcccagccctcttttccattcttcctcttaacatctgacattctacattcacttcactctgttacaaatcattatagatataattataaatgtgtgtgaactaagaaaaataaacaagaatttgtcctactggatactaacacacactacaatgtcatagtaatcaaaatactaggacactggcacaagaagagacaaacagaacagtggaacaagatggaactcagacacaggcccacctataatgggagctttcagtatagcaaaggagacactactaacctatggggaaaaggtgaactatttagtagttgtgggaacacactggcccattatataaagaaaaataaaacatgatccccatcaaacacaaagatgaatcccagatgaattaaagtagtaaatgtgaaatttaaaactgtaggagatgttttaagagtatctttgatatctcagtatagggaagacttcttttaaaaaagacacacaaacaaaaatacagttgatggacttcattacaaaatattaaggatttctcttcaataaaggaaaccaaggagacagttgccagaagtcagattagaggaaaacatttgcaatgcctaaaactgacaagggactactagcaggactatataaggatcacctgcaaatcaataagaaaatgatggaagcacatagtacaaaaatggacaatgaatgtgaacaggcaatttatagaaaaggaacccccaagtggctaatcagtcctaattatagccccaattattagtaattaaagaaatgcaaaataaaacagcatatttctttatgcacatgaaattggcaaaagttagaaaactggataatgtccagtgttgaagtccatttaggagttgcaggacaattagagtactgacaaaggaagttcagatgagtacagccattctgatgagaagatgagcagtgtttagtcaaattaaggagctgcatctccagcaaccctgcaacccctttctaggatacatacattccagggatgcaggtcaggcccacatgtatatgcagttccatgtgagatacaagcattgcttgcaatagtagagaaccaggaatgatccaggtatcccaggagcaatgtagatatgtggattaatatgatttggatatttgtcacttccaagtctcatgttgaaaattgatccccagtgttgcaggtggggcctggtgggaggtatttgaatcatggaggagaccctcatgaatggctttgtcccctctccgggtaatgagtgagttctcactctattagtgcacatgaaacctggttgttaaaaagaggctggcacctctttctatgtctctttctccctctatgaccatgtgatgcactggctccacttgccttccaccatgagtaaaagcttccagaatcccccaacagaagcagatgctagtgccatgtttcgcgtacagcctgcagatctgtgagccatttaaagctcttttcttcgtaaattaggtaacttcagatattcctttatagcaatgcaaaatggactaatgcatggacatataaagtaaaatactatggaagatttggaagaaacaaactggatgtacaaaattagatctataatttaatgccattttggttaattaaaaatacatgtacactggacactactacatattacagaggatctatgcaaataaaaggaaacatcaaattcattaaaatgtttacctatgaggtaggggtaagaggttagatatgggagtaaggactggagataaaagggaccaaataaatcaagggagagagagagagctcggaggcaccaatgatgatcatataatgaactgagaagttcttaaccttttgtacctgaggtccagcatgaataacaataataataatgaattagatgtggtcatctgcatggaagttcactgtctaatgctaagagaattcccaaaacatataaaaatataaagcatggtgagtgttatgataaatagaaacctgtaagatctctggaggggcattttttgtgtgaacattgccatggaatgagtccaagtagagacagtaagtagttacaggcacccaccacactgtgttgtaattatgtatagaaatatagatctgactccattatttggcaatggactctggagaatttgaacttggtcttttccttcacaaaatagggtgaataggacagtggataaacagtcttggatccagactttctggattggaagctagccctactacttcatagctgtgggaacttgatcaaagtgcttaaagtctctgtgtatgtaaaaagatgtaagtatctctcatgtgaaatagtgaaaataatagtacctacctcaaagactatgtgtgagaataaagtgagttaataaatgtaaatcctcagaatagcgcctgaccatattaactactcagttagttatcggtgttgttgttgttatgtggctgaatgcttttaacccattagaagatcaatgaacacttatcagattgaatttttcctcccttccttacattctacaaatcctagggcctcctctttacattcccacctttacagtatttcacagggtcccctgggcccgggggtcatggccagaacgcagagactttatgatgaggacggtgcccacgatgatgccgactaggcccagcaccaggcccagggcacagagcacagtctccgttgtctcaggcatctggattggctcttgggcctctgggggaagaatgaagagatagggtcaggaggtgcagtgagggtggtgatggcctgggatggttgtgggaattgaaggttatggaccagttaattggatgttaggacgaggagaggactgagacccagccagtgcggaaagctggtgcagaggacaccaggtctttggaatagaggatgccaggagattatggagagaaaagcagttgcataccccagtgcttgaggagcggctggtccaagccccagtgctccaccctgcagtcatagaagtcctctgctgagggcacaaaggtcaggtaatggaacttgtggaagctgtaatctgttctgggcaggaagaggctctcagcgacaccctcagtgaccagctccccgttgcacagccacgtgacgttgagcactggtgggaagaacttgtcaatgtggcagatgagggtgttgggctggcccagctccacaggctccttgggaaacacggtcacctcagggggatctggaaggagacagcaccaggttaggcccctcttctgggatgaatcacaaaggctccacctcttaggggagggtggtcctctacctcagccttagattttatggcagctctgaatcacagagaggggtatcacaccactgaccagcctcactctgctcacctttctctctcctgagaagagaggatgcaagcccttgctgtagtgggatcagcccatggccactaggggaagaggatcacacagcagggggcacttaggcttcctagtctgagggtggcagagaggccctctcatcccttccagttgggctacagaggaagaggcaaagatagggcgtaccgttggtggcctgagtgtggttggaacgctggatcaaggtattcaagttgttgttcaatatagcaatgttagccagcccgccctgagcctcaaaggaaaaggcttggccaaactcctccagatgccagacggtctccttcttgtccagatccacatagaacatctcatcttcatcaaattcaaacataaactcccctgttggtctatgcgtctgtacaaacgcggcataagttgacacatggtccgctgcataaagacagtagagaaaaacacgacaaaatgtcagtttgaatatgcaagtggtcaaagctagagaatgaataaagacttatgaatataaaaaggaagaaggtaagaggtcaaaggaaggacatatggggaagaagaaggagcaacaccataaaggaaataatacagagcagatgagcagttataaaaagaaaggagcaaagaacaaaatgaaaagtttatcactgataagtcaagctgcttcctggtctttgaaagtctgggcatcctgaccctacacaatagtaatagtaacaatgacagctaacatttgttgagcacttacttgtgccaggcatccttctaaatactttacatatttcactcgctgaattgtcacaataaccctatgaagcaaatacatatcatacattttacaggtaaggaaatgcagggaagttacatattaataacttgctaaggtcatacggctactggcggaactagtagagaggttttctctcccattaagatcttaatttttctatgacacagatgtaaaattgtttttagagtcatgggggtgggggaatggacattttctttttcttattatagaaaaggtagaaaaaaatacaaaattgagaggaagaagaaaatatccttcaaattttagggctcttgacagttttaaagtttctgtcttagtttatgaacatgaaactgtagaatgtatagctttgttgataatatttttcatttggggcatataaattcaaaagtacagtacagttattttggcatttgttccaaacttttgtttcctttttaaaaatatttcaacatttattttatgttcaggagtacatgtgcaggtttgttgtataggtaaactcatgacttgggggtttagtgtacagattatttcatcacacaggtactaagcattctaaacttttcttacatttatattttgatttttgttttagaggccaactagaaattattgctgagtttggaacacctgtaggatttaatttattttgtttcttagtctttattagtttgtaagaattagcaaagataagaggataaaagcaactattatcatgaaagaaaacgatgaatgtgtatgtgaaagtctgggtttagaatgataaatgcatcagagtgagaaggaactacgggactcttctgctctcacctcccaactcacagatttccctgtgagttttcagccctgacatgtggggacccagtctgtgcttggccacttacagtgacaggagaatgactccttgccactgtaattgtaagtgtctagagggtatgacctgtgtcttatttttcactgagaatgactccctgacacagtaagtggccaagcaaagagtggtatttgaaactaaacaaaacaaatcctataggtatttcactaggaaacttagcttgctcctcagtttaaaggactcaaaggactcatcaggaaaaagagggtaaaataaaaa

SEQ ID NO: 1177 - DNA, 8183 bp, Homo sapiens
aacagaggataaaaggctcaatgaaaggataatctccatattagtgctaccaaagtgtcattaatttctatttgttggaaactttactaaggaatgactgctttgaggtaatggataaggacagagcttgaagggtcagcaattcagtcagccactggagtagttttcacatgaagtgagaagaaaagctgagatggagtttgtagggcagctggagttcagatctctcctaagtcctcttctgttcagatattttgtcacctgcagcaacacacacagttattgtcattcctgggttcagtactgtaagcccggacccatcttccccactccctttgcacccgagcttcccatttctctgccctgttcaggtcccagggagaaggtggtcatccctgcacatgccctggtcctccaggtgaagagcacataggagccaaggagttcacgaaagtcattgaatttcaccctcaaaccccagctgactgtgaggccatcccacatgcttcatgtctccaaaatatacagacaaggggaagggccacattactgagggcagagaagaagcttaaccctggaatgagaattggaagggacaaatatccaaaccatatcaatgacggcaatgaacgaaggatacttgctcacattgtgtatactgctctttgaaaggatttcaaaaaccaaggtaaattttctaaaatgacctctgttgaacatctgacagcagtacttcctccttcctgaattctttaattccttggctcatgtgacagcatattctcctaattcttctgcttctctgcttctccatttttgttaaatactcctctttggatgttttgttaatcatgtatctttgcattaattttgccttttcaagatatttcattaaaatatgatttattactgagttcttttggtatcccccaaattttgcacctaagccaggtgcatcccctacatcaccctagtcccagccctcttttccattcttcctcttaacatctgacattctacattcacttcactctgttacaaatcattatagatataattataaatgtgtgtgaactaagaaaaataaacaagaatttgtcctactggatactaacacacactacaatgtcatagtaatcaaaatactaggacactggcacaagaagagacaaacagaacagtggaacaagatggaactcagacacaggcccacctataatgggagctttcagtatagcaaaggagacactactaacctatggggaaaaggtgaactatttagtagttgtgggaacacactggcccattatataaagaaaaataaaacatgatccccatcaaacacaaagatgaatcccagatgaattaaagtagtaaatgtgaaatttaaaactgtaggagatgttttaagagtatctttgatatctcagtatagggaagacttcttttaaaaaagacacacaaacaaaaatacagttgatggacttcattacaaaatattaaggatttctcttcaataaaggaaaccaaggagacagttgccagaagtcagattagaggaaaacatttgcaatgcctaaaactgacaagggactactagcaggactatataaggatcacctgcaaatcaataagaaaatgatggaagcacatagtacaaaaatggacaatgaatgtgaacaggcaatttatagaaaaggaacccccaagtggctaatcagtcctaattatagccccaattattagtaattaaagaaatgcaaaataaaacagcatatttctttatgcacatgaaattggcaaaagttagaaaactggataatgtccagtgttgaagtccatttaggagttgcaggacaattagagtactgacaaaggaagttcagatgagtacagccattctgatgagaagatgagcagtgtttagtcaaattaaggagctgcatctccagcaaccctgcaacccctttctaggatacatacattccagggatgcaggtcaggcccacatgtatatgcagttccatgtgagatacaagcattgcttgcaatagtagagaaccaggaatgatccaggtatcccaggagcaatgtagatatgtggattaatatgatttggatatttgtcacttccaagtctcatgttgaaaattgatccccagtgttgcaggtggggcctggtgggaggtatttgaatcatggaggagaccctcatgaatggctttgtcccctctccgggtaatgagtgagttctcactctattagtgcacatgaaacctggttgttaaaaagaggctggcacctctttctatgtctctttctccctctatgaccatgtgatgcactggctccacttgccttccaccatgagtaaaagcttccagaatcccccaacagaagcagatgctagtgccatgtttcgcgtacagcctgcagatctgtgagccatttaaagctcttttcttcgtaaattaggtaacttcagatattcctttatagcaatgcaaaatggactaatgcatggacatataaagtaaaatactatggaagatttggaagaaacaaactggatgtacaaaattagatctataatttaatgccattttggttaattaaaaatacatgtacactggacactactacatattacagaggatctatgcaaataaaaggaaacatcaaattcattaaaatgtttacctatgaggtaggggtaagaggttagatatgggagtaaggactggagataaaagggaccaaataaatcaagggagagagagagagctcggaggcaccaatgatgatcatataatgaactgagaagttcttaaccttttgtacctgaggtccagcatgaataacaataataataatgaattagatgtggtcatctgcatggaagttcactgtctaatgctaagagaattcccaaaacatataaaaatataaagcatggtgagtgttatgataaatagaaacctgtaagatctctggaggggcattttttgtgtgaacattgccatggaatgagtccaagtagagacagtaagtagttacaggcacccaccacactgtgttgtaattatgtatagaaatatagatctgactccattatttggcaatggactctggagaatttgaacttggtcttttccttcacaaaatagggtgaataggacagtggataaacagtcttggatccagactttctggattggaagctagccctactacttcatagctgtgggaacttgatcaaagtgcttaaagtctctgtgtatgtaaaaagatgtaagtatctctcatgtgaaatagtgaaaataatagtacctacctcaaagactatgtgtgagaataaagtgagttaataaatgtaaatcctcagaatagcgcctgaccatattaactactcagttagttatcggtgttgttgttgttatgtggctgaatgcttttaacccattagaagatcaatgaacacttatcagattgaatttttcctcccttccttacattctacaaatcctagggcctcctctttacattcccacctttacagtatttcacagggtcccctgggcccgggggtcatggccagaacgcagagactttatgatgaggacggtgcccacgatgatgccgactaggcccagcaccaggcccagggcacagagcacagtctccgttgtctcaggcatctggattggctcttgggcctctgggggaagaatgaagagatagggtcaggaggtgcagtgagggtggtgatggcctgggatggttgtgggaattgaaggttatggaccagttaattggatgttaggacgaggagaggactgagacccagccagtgcggaaagctggtgcagaggacaccaggtctttggaatagaggatgccaggagattatggagagaaaagcagttgcataccccagtgcttgaggagcggctggtccaagccccagtgctccaccctgcagtcatagaagtcctctgctgagggcacaaaggtcaggtaatggaacttgtggaagctgtaatctgttctgggcaggaagaggctctcagcgacaccctcagtgaccagctccccgttgcacagccacgtgacgttgagcactggtgggaagaacttgtcaatgtggcagatgagggtgttgggctggcccagctccacaggctccttgggaaacacggtcacctcagggggatctggaaggagacagcaccaggttaggcccctcttctgggatgaatcacaaaggctccacctcttaggggagggtggtcctctacctcagccttagattttatggcagctctgaatcacagagaggggtatcacaccactgaccagcctcactctgctcacctttctctctcctgagaagagaggatgcaagcccttgctgtagtgggatcagcccatggccactaggggaagaggatcacacagcagggggcacttaggcttcctagtctgagggtggcagagaggccctctcatcccttccagttgggctacagaggaagaggcaaagatagggcgtaccgttggtggcctgagtgtggttggaacgctggatcaaggtattcaagttgttgttcaatatagcaatgttagccagcccgccctgagcctcaaaggaaaaggcttggccaaactcctccagatgccagacggtctccttcttgtccagatccacatagaacatctcatcttcatcaaattcaaacataaactcccctgttggtctatgcgtctgtacaaacgcggcataagttgacacatggtccgctgcataaagacagtagagaaaaacacgacaaaatgtcagtttgaatatgcaagtggtcaaagctagagaatgaataaagacttatgaatataaaaaggaagaaggtaagaggtcaaaggaaggacatatggggaagaagaaggagcaacaccataaaggaaataatacagagcagatgagcagttataaaaagaaaggagcaaagaacaaaatgaaaagtttatcactgataagtcaagctgcttcctggtctttgaaagtctgggcatcctgaccctacacaatagtaatagtaacaatgacagctaacatttgttgagcacttacttgtgccaggcatccttctaaatactttacatatttcactcgctgaattgtcacaataaccctatgaagcaaatacatatcatacattttacaggtaaggaaatgcagggaagttacatattaataacttgctaaggtcatacggctactggcggaactagtagagaggttttctctcccattaagatcttaatttttctatgacacagatgtaaaattgtttttagagtcatgggggtgggggaatggacattttctttttcttattatagaaaaggtagaaaaaaatacaaaattgagaggaagaagaaaatatccttcaaattttagggctcttgacagttttaaagtttctgtcttagtttatgaacatgaaactgtagaatgtatagctttgttgataatatttttcatttggggcatataaattcaaaagtacagtacagttattttggcatttgttccaaacttttgtttcctttttaaaaatatttcaacatttattttatgttcaggagtacatgtgcaggtttgttgtataggtaaactcatgacttgggggtttagtgtacagattatttcatcacacaggtactaagcattctaaacttttcttacatttatattttgatttttgttttagaggccaactagaaattattgctgagtttggaacacctgtaggatttaatttattttgtttcttagtctttattagtttgtaagaattagcaaagataagaggataaaagcaactattatcatgaaagaaaacgatgaatgtgtatgtgaaagtctgggtttagaatgataaatgcatcagagtgagaaggaactacgggactcttctgctctcacctcccaactcacagatttccctgtgagttttcagccctgacatgtggggacccagtctgtgcttggccacttacagtgacaggagaatgactccttgccactgtaattgtaagtgtctagagggtatgacctgtgtcttatttttcactgagaatgactccctgacacagtaagtggccaagcaaagagtggtatttgaaactaaacaaaacaaatcctataggtatttcactaggaaacttagcttgctcctcagtttaaaggactcaaaggactcatcaggaaaaagagggtaaaataaaaagacacaaagtcctctagcagttattggaaactcatcttcttaatacatgaatgtcccttgtactttttaaaatgctttttaaaaaacactttcacaagttctgcagtccaaagatcagccagctatggaacagattatttttcttcaaaatatcatttccattcagacaaaaatatgtattaaaagactactatatgtcaaacactgttagatgctaaatacccaaataaaaataatacatacgtcctgttctgcagacgcgtataagtcacagaaggaaacacaagtgacaggacaacagcaggttcagaaggataagtgcagatacgtaggtatacacaagatgcgaccaaacagcacatcagggaaggcttcctggggaacagatggcttcaatgtaggcattcagaaaacagggcaaaagccacttctctcagggaagacagcctgaccgggagaagatactgagtttactgtggggctattgcacttagaagacctgaaagtcatctaaggagaaataatacatagatatttgtggattatgggtggtctcaggagaggaatttaggccatagaactgagagtcattagtggcaggtgcaggttaaataagattttccaggaagagtgccaaaaatcagaattgccgagatctcagggtataatgagagaacatgatagttaagaggtggtttaaaagatgataaggaggatccaggtaaacaggagaaaaataaggacagggtagttcatcagaaagaagtggattatagtgcaaatgttattagtaactcaagtcagaggcactgagaagaacccactgaatttgaccttctgtagaggttcctgatggccaagatgagaggatcctcagggatgtaccagagacaagtcagaagcttagctccacgtgtgaggacacaaagaaagtgtctctgggacaggatgcagactgaaggcaaggttgttttttatcagttggtttgcacttatgtttttaaggtaaatgacatgtttaaatgttaagagactgggcagggaagccctgaagagacagctgagctcattaggaatttctaccaagaatactaaaaagtatttgcatctatgaagagaagcctattgtggtgtttattataacataacattagaaataactcaggtgaccgcgaacagggcaatagatacttctggttctacccagcctgacctcctctttattctacacatcttaaataaaactgtctgaagccagtgtgcatcttgtacgttatggattctaaccttccccatcactagattttggaatgacagcatcatgcacaggcttgatgtcattctccctgatttcagctacaggaaaaaggagcattcactacggtccatctctggctgagtccttgcagctatcaaaagtctaggcctcccttgcagtcctgaatctctcagaacccgaatcacaaggctatcaagaccatgcaaccctgctgtcttgagagaggaaagcttgtgaccacccacaaagacccaggaagagccctagggtcctagaagagagggaggatacagaaacactctttgcacttcgtctcctaatgcagagtccatagctcggagttcctgtaaagcagccacaaaagatagaggctggggatcccagagagataggagggccctgatagtaggtcactgtgtgcaggaatctggggaaggcagtgtatgaccctcagagctgggtctggacttcaaacttggctcgttgatctgctgtgtaaccttggaaaacttattcatctttttgagcttcagttttttcaaaataatttctaaataaaaggaataatttctaaatgaatggaatattatcttcattgaagattcctgtgagat

SEQ ID NO: 1178 - DNA, 24859 bp, Homo sapiens
aacagaggataaaaggctcaatgaaaggataatctccatattagtgctaccaaagtgtcattaatttctatttgttggaaactttactaaggaatgactgctttgaggtaatggataaggacagagcttgaagggtcagcaattcagtcagccactggagtagttttcacatgaagtgagaagaaaagctgagatggagtttgtagggcagctggagttcagatctctcctaagtcctcttctgttcagatattttgtcacctgcagcaacacacacagttattgtcattcctgggttcagtactgtaagcccggacccatcttccccactccctttgcacccgagcttcccatttctctgccctgttcaggtcccagggagaaggtggtcatccctgcacatgccctggtcctccaggtgaagagcacataggagccaaggagttcacgaaagtcattgaatttcaccctcaaaccccagctgactgtgaggccatcccacatgcttcatgtctccaaaatatacagacaaggggaagggccacattactgagggcagagaagaagcttaaccctggaatgagaattggaagggacaaatatccaaaccatatcaatgacggcaatgaacgaaggatacttgctcacattgtgtatactgctctttgaaaggatttcaaaaaccaaggtaaattttctaaaatgacctctgttgaacatctgacagcagtacttcctccttcctgaattctttaattccttggctcatgtgacagcatattctcctaattcttctgcttctctgcttctccatttttgttaaatactcctctttggatgttttgttaatcatgtatctttgcattaattttgccttttcaagatatttcattaaaatatgatttattactgagttcttttggtatcccccaaattttgcacctaagccaggtgcatcccctacatcaccctagtcccagccctcttttccattcttcctcttaacatctgacattctacattcacttcactctgttacaaatcattatagatataattataaatgtgtgtgaactaagaaaaataaacaagaatttgtcctactggatactaacacacactacaatgtcatagtaatcaaaatactaggacactggcacaagaagagacaaacagaacagtggaacaagatggaactcagacacaggcccacctataatgggagctttcagtatagcaaaggagacactactaacctatggggaaaaggtgaactatttagtagttgtgggaacacactggcccattatataaagaaaaataaaacatgatccccatcaaacacaaagatgaatcccagatgaattaaagtagtaaatgtgaaatttaaaactgtaggagatgttttaagagtatctttgatatctcagtatagggaagacttcttttaaaaaagacacacaaacaaaaatacagttgatggacttcattacaaaatattaaggatttctcttcaataaaggaaaccaaggagacagttgccagaagtcagattagaggaaaacatttgcaatgcctaaaactgacaagggactactagcaggactatataaggatcacctgcaaatcaataagaaaatgatggaagcacatagtacaaaaatggacaatgaatgtgaacaggcaatttatagaaaaggaacccccaagtggctaatcagtcctaattatagccccaattattagtaattaaagaaatgcaaaataaaacagcatatttctttatgcacatgaaattggcaaaagttagaaaactggataatgtccagtgttgaagtccatttaggagttgcaggacaattagagtactgacaaaggaagttcagatgagtacagccattctgatgagaagatgagcagtgtttagtcaaattaaggagctgcatctccagcaaccctgcaacccctttctaggatacatacattccagggatgcaggtcaggcccacatgtatatgcagttccatgtgagatacaagcattgcttgcaatagtagagaaccaggaatgatccaggtatcccaggagcaatgtagatatgtggattaatatgatttggatatttgtcacttccaagtctcatgttgaaaattgatccccagtgttgcaggtggggcctggtgggaggtatttgaatcatggaggagaccctcatgaatggctttgtcccctctccgggtaatgagtgagttctcactctattagtgcacatgaaacctggttgttaaaaagaggctggcacctctttctatgtctctttctccctctatgaccatgtgatgcactggctccacttgccttccaccatgagtaaaagcttccagaatcccccaacagaagcagatgctagtgccatgtttcgcgtacagcctgcagatctgtgagccatttaaagctcttttcttcgtaaattaggtaacttcagatattcctttatagcaatgcaaaatggactaatgcatggacatataaagtaaaatactatggaagatttggaagaaacaaactggatgtacaaaattagatctataatttaatgccattttggttaattaaaaatacatgtacactggacactactacatattacagaggatctatgcaaataaaaggaaacatcaaattcattaaaatgtttacctatgaggtaggggtaagaggttagatatgggagtaaggactggagataaaagggaccaaataaatcaagggagagagagagagctcggaggcaccaatgatgatcatataatgaactgagaagttcttaaccttttgtacctgaggtccagcatgaataacaataataataatgaattagatgtggtcatctgcatggaagttcactgtctaatgctaagagaattcccaaaacatataaaaatataaagcatggtgagtgttatgataaatagaaacctgtaagatctctggaggggcattttttgtgtgaacattgccatggaatgagtccaagtagagacagtaagtagttacaggcacccaccacactgtgttgtaattatgtatagaaatatagatctgactccattatttggcaatggactctggagaatttgaacttggtcttttccttcacaaaatagggtgaataggacagtggataaacagtcttggatccagactttctggattggaagctagccctactacttcatagctgtgggaacttgatcaaagtgcttaaagtctctgtgtatgtaaaaagatgtaagtatctctcatgtgaaatagtgaaaataatagtacctacctcaaagactatgtgtgagaataaagtgagttaataaatgtaaatcctcagaatagcgcctgaccatattaactactcagttagttatcggtgttgttgttgttatgtggctgaatgcttttaacccattagaagatcaatgaacacttatcagattgaatttttcctcccttccttacattctacaaatcctagggcctcctctttacattcccacctttacagtatttcacagggtcccctgggcccgggggtcatggccagaacgcagagactttatgatgaggacggtgcccacgatgatgccgactaggcccagcaccaggcccagggcacagagcacagtctccgttgtctcaggcatctggattggctcttgggcctctgggggaagaatgaagagatagggtcaggaggtgcagtgagggtggtgatggcctgggatggttgtgggaattgaaggttatggaccagttaattggatgttaggacgaggagaggactgagacccagccagtgcggaaagctggtgcagaggacaccaggtctttggaatagaggatgccaggagattatggagagaaaagcagttgcataccccagtgcttgaggagcggctggtccaagccccagtgctccaccctgcagtcatagaagtcctctgctgagggcacaaaggtcaggtaatggaacttgtggaagctgtaatctgttctgggcaggaagaggctctcagcgacaccctcagtgaccagctccccgttgcacagccacgtgacgttgagcactggtgggaagaacttgtcaatgtggcagatgagggtgttgggctggcccagctccacaggctccttgggaaacacggtcacctcagggggatctggaaggagacagcaccaggttaggcccctcttctgggatgaatcacaaaggctccacctcttaggggagggtggtcctctacctcagccttagattttatggcagctctgaatcacagagaggggtatcacaccactgaccagcctcactctgctcacctttctctctcctgagaagagaggatgcaagcccttgctgtagtgggatcagcccatggccactaggggaagaggatcacacagcagggggcacttaggcttcctagtctgagggtggcagagaggccctctcatcccttccagttgggctacagaggaagaggcaaagatagggcgtaccgttggtggcctgagtgtggttggaacgctggatcaaggtattcaagttgttgttcaatatagcaatgttagccagcccgccctgagcctcaaaggaaaaggcttggccaaactcctccagatgccagacggtctccttcttgtccagatccacatagaacatctcatcttcatcaaattcaaacataaactcccctgttggtctatgcgtctgtacaaacgcggcataagttgacacatggtccgctgcataaagacagtagagaaaaacacgacaaaatgtcagtttgaatatgcaagtggtcaaagctagagaatgaataaagacttatgaatataaaaaggaagaaggtaagaggtcaaaggaaggacatatggggaagaagaaggagcaacaccataaaggaaataatacagagcagatgagcagttataaaaagaaaggagcaaagaacaaaatgaaaagtttatcactgataagtcaagctgcttcctggtctttgaaagtctgggcatcctgaccctacacaatagtaatagtaacaatgacagctaacatttgttgagcacttacttgtgccaggcatccttctaaatactttacatatttcactcgctgaattgtcacaataaccctatgaagcaaatacatatcatacattttacaggtaaggaaatgcagggaagttacatattaataacttgctaaggtcatacggctactggcggaactagtagagaggttttctctcccattaagatcttaatttttctatgacacagatgtaaaattgtttttagagtcatgggggtgggggaatggacattttctttttcttattatagaaaaggtagaaaaaaatacaaaattgagaggaagaagaaaatatccttcaaattttagggctcttgacagttttaaagtttctgtcttagtttatgaacatgaaactgtagaatgtatagctttgttgataatatttttcatttggggcatataaattcaaaagtacagtacagttattttggcatttgttccaaacttttgtttcctttttaaaaatatttcaacatttattttatgttcaggagtacatgtgcaggtttgttgtataggtaaactcatgacttgggggtttagtgtacagattatttcatcacacaggtactaagcattctaaacttttcttacatttatattttgatttttgttttagaggccaactagaaattattgctgagtttggaacacctgtaggatttaatttattttgtttcttagtctttattagtttgtaagaattagcaaagataagaggataaaagcaactattatcatgaaagaaaacgatgaatgtgtatgtgaaagtctgggtttagaatgataaatgcatcagagtgagaaggaactacgggactcttctgctctcacctcccaactcacagatttccctgtgagttttcagccctgacatgtggggacccagtctgtgcttggccacttacagtgacaggagaatgactccttgccactgtaattgtaagtgtctagagggtatgacctgtgtcttatttttcactgagaatgactccctgacacagtaagtggccaagcaaagagtggtatttgaaactaaacaaaacaaatcctataggtatttcactaggaaacttagcttgctcctcagtttaaaggactcaaaggactcatcaggaaaaagagggtaaaataaaaagacacaaagtcctctagcagttattggaaactcatcttcttaatacatgaatgtcccttgtactttttaaaatgctttttaaaaaacactttcacaagttctgcagtccaaagatcagccagctatggaacagattatttttcttcaaaatatcatttccattcagacaaaaatatgtattaaaagactactatatgtcaaacactgttagatgctaaatacccaaataaaaataatacatacgtcctgttctgcagacgcgtataagtcacagaaggaaacacaagtgacaggacaacagcaggttcagaaggataagtgcagatacgtaggtatacacaagatgcgaccaaacagcacatcagggaaggcttcctggggaacagatggcttcaatgtaggcattcagaaaacagggcaaaagccacttctctcagggaagacagcctgaccgggagaagatactgagtttactgtggggctattgcacttagaagacctgaaagtcatctaaggagaaataatacatagatatttgtggattatgggtggtctcaggagaggaatttaggccatagaactgagagtcattagtggcaggtgcaggttaaataagattttccaggaagagtgccaaaaatcagaattgccgagatctcagggtataatgagagaacatgatagttaagaggtggtttaaaagatgataaggaggatccaggtaaacaggagaaaaataaggacagggtagttcatcagaaagaagtggattatagtgcaaatgttattagtaactcaagtcagaggcactgagaagaacccactgaatttgaccttctgtagaggttcctgatggccaagatgagaggatcctcagggatgtaccagagacaagtcagaagcttagctccacgtgtgaggacacaaagaaagtgtctctgggacaggatgcagactgaaggcaaggttgttttttatcagttggtttgcacttatgtttttaaggtaaatgacatgtttaaatgttaagagactgggcagggaagccctgaagagacagctgagctcattaggaatttctaccaagaatactaaaaagtatttgcatctatgaagagaagcctattgtggtgtttattataacataacattagaaataactcaggtgaccgcgaacagggcaatagatacttctggttctacccagcctgacctcctctttattctacacatcttaaataaaactgtctgaagccagtgtgcatcttgtacgttatggattctaaccttccccatcactagattttggaatgacagcatcatgcacaggcttgatgtcattctccctgatttcagctacaggaaaaaggagcattcactacggtccatctctggctgagtccttgcagctatcaaaagtctaggcctcccttgcagtcctgaatctctcagaacccgaatcacaaggctatcaagaccatgcaaccctgctgtcttgagagaggaaagcttgtgaccacccacaaagacccaggaagagccctagggtcctagaagagagggaggatacagaaacactctttgcacttcgtctcctaatgcagagtccatagctcggagttcctgtaaagcagccacaaaagatagaggctggggatcccagagagataggagggccctgatagtaggtcactgtgtgcaggaatctggggaaggcagtgtatgaccctcagagctgggtctggacttcaaacttggctcgttgatctgctgtgtaaccttggaaaacttattcatctttttgagcttcagttttttcaaaataatttctaaataaaaggaataatttctaaatgaatggaatattatcttcattgaagattcctgtgagatgtaaatggggaaagaaactatgcaggagtctcataaattctggctgttattgctgttattattatgagggccagagggaacatagactatgaggaccagatagatcaatgagcccctaaaatctgtgatccctgaagcagcaattgatgtgaaccaccccatcactcaccccgacgctcctgcgtcctcctgagcactcacccttgatggccccagctcctcggagactcagcaggaaagccaaggagagggctctcaagatcacagctctgatatggaacattctgtcttcagggcgcatgttgtggggtctataattgatgactgtgagcacaggaacagtgatgaggaactgaggccgagtggaggcagatgagactgaaactgtgggcctctagcactggaaatgggtggagaggaatcagcatggctgggattcacctatcagagaaatcatagagctgacattctctgttgctgggtaaagaggacgctggaaggtgctggggaagagatgggagaattttaggtaccagcgtggtcaagagagctccagttcacagttcattttcagagttagagaaagagatgtaaaaagataagttacaccttcttctgacggcaaatgttttccattatgttccttctcccgagccccacccccatcccagacagtcagatgatctttgatgttttttggtcactatattttaaatcatgttttatgttatgttgtcaatattttacaaaaatattctgctgataattaagaatgaatgtgctatctaataaaatatataattaatctttctttcaggtccacctccctgagatacctcctttttatttaatcatttctgcagaagtgttataatttctatttagaggttttaattaacttgaatgaagttgatctttaattgtttatctattcctggttacctttgttagtgaaatttctagataatttttatttttcagatttcttagtatttgatttttcctggtatttaaacagtgtaataacatttttatctttaaattactagtcttgttatttcattttcatataagaatacccaggacagcattacctgtggtaacaatgtgcgcccatattttgatcttgtttttaagaagggtttctctaatgtttttctgttacaggtaatgttaattttttattttatattctctttaccatatttaagaaatacttttctagtctcattttaaatatttcaattttgagctatttatttgatactcatagagaaggtcacaaaacatttactatttaatgtaatgatgaagtacatatattacgttaatattttatcttatttgtggtagccttaccttgcataaataataattactaacagattaggacatgagagattctgttattagtgctttgcatgcattacctcatttaaacctcatattaaacctgagggaggtattattaatgtctactgtaaaaataaattacctgagacatcgaggaagtatttgtctaattatctatggcaggtaaatgacaaggagaaaagtcccacccaggcagttactaaaaaaactgagtttttctccacaatcctctcctggccccttaatcctactagacaccttctactacataattattttcttctcttgcattttacatgctagccttctatttacattttaatattgatttaaagaaatgatgccaatttgattttttttgaaattagaattggtggtccaacaggatcacatttataagtgtctaaagtaagaagtaatgttctttgaaagtttgtaaaaatattcactctaaacaaaatagaatcagatgctttgaaggaggtggggtctttgatgattttttttcactttcttccttatttaccagtcaatttatattctctatggactttatttttccaaagcaatttcagacctattgatctcatttgatcttaagagctttgctataaggcaggttatatcatccccatattgaagacaaggaatcgaagtccaagagaggcagtgtcgttaaagctgcatatttacatggtagggtaggtggtgtgtccacgctcccagtgtaaggtccctagactgagccctcctgaccctgatgacagtcctgtggaagaacctggtaactcctgcacatcgcaggactcacagacctctgggagaaagtaaatatgaatgggtgctaatcttaaacacacccttggacaaaggcaagacagacagactcagacctcatttgagttctgagatgggtactctaatccctctaagtcatgccactgaatgaccttttacacactaagatagcactttttccacaacagaccatgtcctgtgggtgtgtgaggtgtggcagaattggggaaatgataatccctgtagatgggccagcagaatatttgagatcaccttcagagcaaagaaaacgcataatctccccaaacatcatgacttatctgactggttaaaatgagtatcactgtctttcctccgtcatcttaagtgcatcacaggctttatattttcagacctttcatactaactttctgcctagtgagcaatgactcatacaaagctcagtgtccattggttcttttctcagactctgtccaatcccagggtcacagaagactacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccaggtaagagccgaactgccattcttggagggtctggctcagggaacaattcctaggggacgttatctttaagggatcaaattctgagacaggctgcgggggctcctgccctaaggcagtgtcctctcttcccagctagagaaagaggttcatcccctataggatagcttgctaccctactggcctattctctctccaaggacatgggtacagtaaacagagagaggtgcccagtggtcagtgtctttggggaaaatgggaccaagaggtcctggataaccttggacagacaaggtttgcagagagagaagttggcaagtgcaggctcctgggcgtgttcatgtctgcatccagcctggaggggactcaggcagagagccctaagctggagtgtccaggctctgaggatcactgaggattcagtgctcacgaagaatgcctcttattccccagggtggagcaggagcccacatcccttggacaattaaggagagaagggagggagggggataggttttagcccctgaaggcattctcattaaaggtacttctcccagcctccccagaacttggttagggtactagagtgggttgcgacttgtaggaagaatgagatgaggttgtgtgggtgcatgacagggattgagtgtaggttatcagacagccaaggaagcagtaaccaagtgaaaaatctcttcttcctgctgcctccctgtggctggtgtaatattatggcatctatgatccattgtttttctctcaggatactctcaggatatttctttttatatatatatatactttaagttctagggtacatgtgcacaacgtgcaggtttgttacatatgtatacatgtgccatgttggtgtgctgcacccattaactcgtcatttacattaggtatatttcctaatgctatccctcccccctccccccaccccacaacaggccccggtgtatgatgttccccttcctgtgtccatgtgttctcattgttcagttcccacctatgagtgagaacatgtggtctttggttttttgtccttgcaatagtttgctgtgaatgatgatttccagcttcctccatgtccctacaaaggacatgaactcatccttttttatggctgcacagtattccatggtgtatatgtgtgcattttcttaatccagtctatcactgatggacagttgggttggttccaagtctttgctattgtgaatagtgccgcaataaacatatgtgtgcatgtgtctttatagcagcatgatttataatcctttgggtatatatccagtaatgggatggctgggtcaaatggtatttctagttctagatctttgaggaattgccacactgtcttgagataccatctcacaccagttaaaatggcgatcattaaaaagtcaggaaacaacaggtgctggagaggatgtggagaaataggaacacttttactctgttggtgggactgtaaactagttcaaccattgtactctcaggacatttctagtccaaatttacaccaacactctgagaggaaggactgcaaagtaggtaccttagttttccactgacttccacttttcctgcttacacccttcctcctagacctctccacacccctcctaggacacacctagaaggtactgacatcatgtcacctcctcatctttcagggtagcaaggttggaatctcctgaatacagcccctcaagccctaaaacctcttatctattaccttgggttcattgtccaggaaggggaggagaacttgaacttgtagtcacagaagggtgctgagaactaaccagcaggacggctcagccctgggaactgcagaggggtgaggctggggagagaggaggctggagcagcactggtgacactgaacagtgtcaggaggaagtgacggatgcagcgcccccatcccataggcagagctgtcatgtgggatgagggacagtgttgggagccaccaaggaaacccagaggtgggggagcagagagcagaagggggcatgtgatgctgggcagtgaaagggaggacgggcaaaggctgggttgaggtttgtagggggaatgagatgaggcagtggagccatgtgacagggactgagggtagattactggagctccctgcgtagaatgaatgttcaatcaaaacctgctggagggagagctggagccataggggagtgggtaaagtgggcagggctgattccacaattccctgcatgctcccccaactccacacacatccccaacctcaaacagggcacaagaccaaagggctgaggagccaggctatagcttaaagaggctgggggagaaaagcttggctgagacaacccatagggagctagaggtttttaatatatcctattctgaataagagacgaattcattcagatcagtggtttcaaaccgtgctctgggcaactcaattgctaagggttccacaaacaggataaagtttcttatatacaaaaaaaaatgaaggtttcaaattacaccataaaacccctcattgcttatgtctacttggcaggtaaaattccatttcaaaagttaaatgtacttaaaaaattacctaagactgggtaaattaaaaaaattaaatgttgcaaagaaaaaattcaaaattcttattcttgaatgaaaaacgttctcttactggtgattgaggaggagaaacaaagactaacaaatgaaaatgggagaatccacactcagagtggggcaattgaacaggcaggggcggatggatggcagaggaggaggaatctggactcaaggagctggggggctctgggcctggaattttagggtctggggcccaaggcaccaggagaagaggcaggtcaggatatctgagtcaagacctgggatcttgccttagcaatgacactggagactaaaggtggactccatggtgcccttgagcccagccctaccccatctccactatcctctgccaccagctgtgcaacttctgctaggggtgaggttaataaactggagaagttaatttgtggagcatgaaacagatgagcagaacaatcacagcaccttaatttccccagtgtgcccaagaacagagcaggcctgaagatactcaaacagaaacaaacatgtgccgtgtcactgataattctgtgtagacacacacctgccagacactgctcatggcactccctaggaagaacagcatgtgggaaaggctgccaaaattgttcatgtaaaaattacatcaatgctgtcttcctcggtgctgcctatgcagctggcagccatctcttcctccacatcatggcctccctcagactcctcatgaaggataagatcctcaaaaagaggaccaacaagttcatgaggcaccaatcagactgaaatgtcaaaattaagcataactggcggaaacccagaggtcttaacagtagggttcgtagaaggtccaagggccagatcttgatgcccaacattgcttatgggagcaacaacaacaacaaaaaaaacatgctgcccagtggcttccagaagtttctggtccacagcctcaaggagctgaaagtgctgctgatgtgcaacaaatcttactgtgctgagatcgctcacaaaatttcctccagaactgcaaagtcatcatggaaagagtcacccagccggccatcagagtcaccaaccccagtaccagggtgcacagctaagaaaatgagtagaaagttcatgtccacgttttgtgtgtaaataaaaccataaaaactgccaaaaaaaattacatcaatgcctctaaacccaaaggactctacccccacaggtccctggttgttgtggtgattttcattgtgtaaaatactttccacatcttttgacaccaagtctttctgcagccatgtttgaaaattaactttcaggctacagagtctttcttataccaaagttgaagaaagttttaagaaatatatttctacatctcctacatgcaaaacaacaggagcaagttgaggaattctcaagaaactggtcgagaagagagagcgcttagctatggaaaagagaaagaaggaagggagggcttcctggaggaggtggcatttgaaccaggactgacatcaggatggaaatgtcagtcagggagttaagtagggggagcagctccgccctccacgtccccagctcctcccgcccctgttttttctcccagtgaccccacgtgaaacgtctccgcctcctccagccaccagcagaagggactgccttcccctcagtgctcgcccctccctagtgatcactcagtgcccctgagctcattcttttcagtaaattctctctctgcgtggtgagaaaacaggcctggagaggctctgcgacccgcttaggaccacagaactcggtactaggaaaactcctattttaaaatccagccctgggtgggaagatttgggaagaatcgttaatattgagagagagagggagaaagaggattagatgagagtggcgcctccgctcatgtccgccccctccccgcagagaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgaggtgagtgagggctttgggccggcggtcccagggcagccccgcgggcccgtgcccagggcgcaggagcagccgggttggcctaagggaccttagtgccgggcggaaaggggactttgggttggggattcatggggggagcccatctggagcttgtcaggggagcgagcgcggggacctggactgggctgagcatggagtgaggaggacgagagcagagagacccccgggacttcatcaggcctggcagctgactgcatgtggggtgaaaaaaggaagccacaggacagcgcacaagggtatggtgtggagatggaggtggagatggcacagcaggccacacagagaagaaacctacagggaggtagctgggtttgaggtgcttgaggggcagatgggtggtctgatgggcaggtagacagaagggtctgcagccggggaggagactgagatacatgagaccatccagggagaggggacccagggggaagagcaaaggaccggatcctgggaactggacagttgtgatttggccaagacagaaaagcctgtgaaagagaccaaaaaaacccaagtgcagtgtgaggagaggcccgcagagaagagtcttggaagctgaggggaggtgacctcagcagcacagtggacagcggtgccagtgacttgggaaggtcagaaaacagaagatggaaagtgggtttggaaaccagggagacctggggagagcaggttggccgcagcggcaggagctggaatgggagggggtgcatgaggctgagtgtggcgcatcctcctcggggctgagatggattttacttgtcttgggttccccacggctgtcacagggcagtgtctcagttcattcgtctttttccttcaggaagtctgggtgtaaagggatggagagaggtgaggtgtgtgcagtaagaggatttctcaaggatgggacaggaaggccttggagctttggcttcctcctgtgaacttgtggggtggggagcctggtgcaccaacctgagggacttgagggagtagtatcaggatgtgggattgagccctggaccttttttctagaaagaggaaaaaaatgaagggaggaggaggaggaagctggggagatcacacctttgattttcttgttcctggaaagtgaaaggaagttcacctgctatgagtgagaaggtggacacactgggtggggatgaggtgagtgacatgagcttaggaaagttgctgaggtaattggttgagagaggtgttcaaataaaaataacgcaattggcaaaaactgttactaagactttgtagaggcaccaatcagtgacatggcagcattttctttcacagtaatcaactgccagattgcagacagccctgatgccagcctaaggagtgtgggtttctcctccaggcccgcaggtccccaacctcactcctctgaagactcttctggagatcctctgtgatgcacagatctccagactcagtgcccccagactcagattccctgggtggggaggtctggggatctctgcttgtaatcagctccctagaggttcccatgtagccagataagtattgtcagaacactgaagatttttgaaaaatgaaaaagagaaggttggagatgtgtcttcagaagactactaagggtgctggctagaggagggaccagaggcagggagatgaggtaggaaactgctattatttgtcagggaaattgcaatcaaggcatgagttagaacagggaaaacacagaggcaagggagaggtggaagggggaggaaagaagtagtgacaattccagggtggatgtccacccaaatctagaagtaattgagcaaatgttttctgggcattagagaaggcaactagaacaaacaggaatccttgccttggtgaaatgtatttgaactgggtcagaaatgaggccattgggtatcaggccttaactccagcgcaccctggaggtcactgatgtggctccaggctgacctgctcctgtcaaagaatattgagcaagatgcctctcgtggaatgttctgggaccttaaaacagatacccaagtattccccctgatttcatggttcccagaagctctatggggaagaaattgtaggtaattcacaactgagatttagacataagttgaatagtgtaatggacattgagttaaccgaggtaatgaagtagtgagacacaggtgcccctgaaataaactcacattgagggaagaggctgacaatgtggatcagtctgaaaacaaggcaaaaatacaatagggagtaagggttgtgtgtcagttcaagactgtacttttacctggcccagcgccatgttagggtatttgtgttctccaggaagtagaaaggaaagaactgagtgattagggacctagaagactaatttgagacattcctcttgatgagctgttctctagggtagtcctctgaaagagctgttctctagtggatctccctgaatgaactgttctctaggagcacttgacccttttctgtgtttgttttttgttttgtgtttgtgtttgtttttgagacaggttctcactttgtctcccaggctggagtgctgtggcaccatcatggctcactgcagcctcaacctcctgggctcaagtgatcctcctgcctcagcctcccatgtagctagaactacagatacacgtaccaccatgtctggctaatttatttttctttttagagatgggttctcactatgttgcccaggccggtctcaaaaccctgggctcaagtgatcctcatgcctcaacctcccaaagtgctaagattataggcatgaccaccatgcctggccttttctgctttctgaggaggaaaaaggtactggtggcagagatccaaaagaaaagttgccagtggcagtgtggaaattcacctgagaacaacaggacaagctggggcacaaatgcaaagatgcagagggaggcaacacctggtcatctgtgagaccttcatgggacctgaagacgcagcacagaggaggaacttgaaaaaggacgggatttctactactcaagcatgtaggagctcaggatattctgtaaatatgaagattttgagtttttgtaggtgaggtaaaaaaatacataggttttttacagaataagacatgtaaagctctcttcattttctttgtattttcatgaagttattagattcacaggccaccataatgccattgtctgtatatcttaatttcaagatattatttgagtaaattttgcttcctttgtatcaagatagaactttgaaaaggtaggtaatttcacagttgatcaaatattctttgcccaaattacttttggttaaaatttctcctaaatgtgctacagagtgcaaactctgtctccctgccattccgctatatacttactaactattattttattcaagatcatgcatgctctacttgaaggtctatttctatcttttcaatgctacccttacccactagcctaatcacattattcctattttcaacatctaggaatcaattacatagtgaacatgcctaagaaataataatctgggcagatgcagtggctcaggcccgtaatcccagccctttgagaggccgagcgggtggatcacttgaggtcaggcgttggtcaagtgctcctagagaaccaggctgaccaacatggagaaaccttgtctctactaataatacaaaaattagccaggtgaagtggcaggcacctataatcccagctattcgggaggctgaggaaggagaattggttgaagcccggaggtggaggttgcagtgagccaatattgcgccactgcattccagacttggcaacagagtgacactccatctcaacaaaaagaaagaatgaaagaaagaaagagcgagattatgtctcaaaaaaaaggaaggaaggaaggaaggaaggaaggaaggaaggaaggaaggaaggaaagaaggacaatctcaaattctatttcattatttttcttccacgctcctagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggagtgagtctctgatgaccctctagaccccacctctgaagagcaggggactctctggctctggggtccactcatcttatcttctgcatctataccctggggccatgtccaaaccccatctttcttctataccagctcctgagcatagtttgaagccagggaaatggagacttcctgaccttggcttaggggttcctgaagattcatagttctcccccttgtcagagaatctagggacactgactggtctcgaaaccctcacacttaggaactgacctcacacataggaacagttctcttccttcagcattttagcctcttctcaggcattttgagaggcaacttccagaatcagcatttgccaccttgttgaggtcacacccctgttccagatatgagggtggctctttctgaatttcctcttagcaagctttttccgctgcactgtcctcatcccgatatgctgcatcaggctccagaatctcagacaggacatgagtagggatgcagctggtggaggtgacactaaacctgggtctgtccttcccagaggcacagtctgattctgcccggagtaagacattgacgggagctgggggcttcgtgctggggctcatcatctgtggagtgggcatcttcatgcacaggaggagcaagaaaggtgagaaagcctgcagggtgagcgggacttaccttcccctggcatattcacacttattccacgatgaggggtttgacagaaaagaaatgtcagaaagctctagaggccactgatatcagataatcggggaacaaacatgacctatagcgagagagggatcccaggctgggatcttaatgcagccagatgcatgaggtcccaagtactcaggctcctgcggagcgtccattgagtgatgggcaatggaatttggtgggatggaaatgtttctctaattatctgaggtggtttcaatggctgattatataacctttcgtctttcatttcagttcaacgaggatctgcataaacaggtaatattcctgctttgatttccttgtggggtgggttgcaggaggatatgagtcctttctgtgcattgtaacactgaggctcctccaggaagggaatctcaggcatgaacccctctttcaatgtcagccttcaggcaagtggggaaagagcattgcttggctccattgctgaaggaagcagagatcaactctgttatttatcagcctgagacgcatcctctcaccataatttttctctcctggacttacaggaaggaggctggcaacctgggataacttgtcttttacccccacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaaccattttctttgtgtgccatcacaaatactccttaaccaaatacggcttggacttttgaatgcatccaatagacgtcatttgtcgtctaagtctgcattcatccaccagcctaggcctcctgtcttaattttcatacagacagaaatgactccccactggggaaagagcaaagcaatacatgtagcactctttttcaaacactggtctttttttttttcttaacaatccaacattgttatgtgttttgcgtctcatattgacaccttttggtcaaggtagaggacatgtttgttgtaagctttctttttcgtgtagaggatggattcttcactcctgatacacacaatcagtgcacagcagctctcttatacatccagttgatgccttcagtctccctggcttcttacaagcatcttctgggccttgtgtgtccctgggcacctgtccctggtcaattcccgaaagctactgtgctcctcttgcccatctccccttgcaaataatatcttccatcgggggaccggcttcctccaatttcaggagaggtggggctgaaggcacagacttgggcgtcactggcacagatataagtaaatacagctggagtctgcagagaggctggactgagtcagggagtcaggaaagagaagccacacacaaggacaaccaatcatgtttctcataatcttcttaacctagggaataggacacaatcattttttctttttaaaacatctttatccctgatcagcctcatttcctcaaaaactataaaggaaaatgctgctgacttgtttttgcgtagtaatttcagctgtcacataataagctaaggaagacagtatatagtaaataaggaccctttatctgtcttattttcccttttggcttcacaggaaacttgtgagaaacctatgcagcataaaattaatatgatttcaatccagggattcaacgatggaaggaggtcatgagaatagcagaaagtcttcaaatcgagatcattatgaaatcctcagacccagagcacataaatcctaccctcagagtcactgagcagttaacattacaaattacaaaccatatccagtcagagtcattctctttcctgcttgtctcctgtactcatgttacaggttagggcagtaccccgagtggagtgaacaatctctggactaacacttgtcaggatcagaagctgaggtatctgcacccacattacaggaacaggatatgtgctcctagggaactgagggtgtcaggagatgaggaatgtccctggagtcacagaaagaaggtatcagatgtgtctcactctgacatatgcaggtgtttatgaaactctgggatttctaaggaaggatgcagtgcagagacaggtcccagaggagacaagagctgagagaccatccaaactgggaccaccttgtcactagacttcaaattttcaatattgatagagtgttttctaagagtcaggccctttgctgagtgctatgtgcagcaggatcaaaggcagccaggaggtagaggagtcttgaggtacatcagtcattggagttgaagagcagagattcaaaggaaagttggaactggagctttaaaggagatgtgaagtgggtgactcaacctctgactcagaaaaattgatacctgcagaagaaaaaacccggcgggcttaggactcccagctgagtgttgtatcctccatccctttccacctggtcccttcattttctacccctcacagttccctaacgagaaggtggtccacccaacagacaacactgcctcagatggttatcaaggggtaccctaagaagaaatcatctcaccctctctttgtccccatttgtcaagtagcagtgaggccgagccaggggatggtgaaagtggaaggaggtgggagttgggcatcgggtgtgaagatgctcttgaaaggggttttaataaccacttgctaccaggccagtgaacacttaccatagttgatgccttttgagcatgttgcattgtaaactgtccctgaaattactgtgcacttggcttatgggatgaaacatcctcctagttcttttgtctctcagcttctctgaagtctcattgagcaccttctcttcaatttcttttacacagtaagaataggatcagctgtgctaaactaacaaatacccagatatccaggtttggctcatgttacacgtccaaagtaagtcatgcaggaagctctgctcatcatcgtactcaggaagtcaggctgacagtctttctcctgcacatctgctcccagaacctccccagcagaatgaagggaacctaagaatttattcactggcttttaatgatccctcctagaaagaacacacttctcgcatttcattttccaatgtaaatcatatggctgcaactaacttcaaataagtgggaatacttgaaggtggaaaacatttaagaagtacacactaaataaataataaaatacttctacaagagatatttatggaggacctactgtgtaccaggagcaatgctaggcattatggatatcagcagcctttggctcctgaaaagcttacacactacctcctggcctaaggaggggcacagggatgctggcaacagtctatttcttcacccgggtactagttacatgggtgcttgcggtgataaccattcaacgtacattctattggtttgtgtgtttcttccaaatgtcccctagttcacaatagaaagggcttaa
